US012522856B2

(12) United States Patent
Scharfe et al.

(10) Patent No.: US 12,522,856 B2
(45) Date of Patent: Jan. 13, 2026

(54) METHODS AND SYSTEMS FOR MULTIPLEX GENE AMPLIFICATION FROM ULTRA-LOW DNA INPUT AMOUNTS AND USES THEREOF

(71) Applicant: The Board of Trustees of the Leland Stanford Junior University, Stanford, CA (US)

(72) Inventors: Curt Scharfe, North Haven, CT (US); Peidong Shen, Union City, CA (US); Ronald W. Davis, Palo Alto, CA (US)

(73) Assignee: The Board of Trustees of the Leland Stanford Junior University, Stanford, CA (US)

( * ) Notice: Subject to any disclaimer, the term of this patent is extended or adjusted under 35 U.S.C. 154(b) by 1066 days.

(21) Appl. No.: 17/275,566

(22) PCT Filed: Sep. 11, 2019

(86) PCT No.: PCT/US2019/050616
§ 371 (c)(1),
(2) Date: Mar. 11, 2021

(87) PCT Pub. No.: WO2020/056004
PCT Pub. Date: Mar. 19, 2020

(65) Prior Publication Data
US 2022/0098640 A1 Mar. 31, 2022

Related U.S. Application Data

(60) Provisional application No. 62/729,921, filed on Sep. 11, 2018.

(51) Int. Cl.
*C12Q 1/6806* (2018.01)

(52) U.S. Cl.
CPC .................. *C12Q 1/6806* (2013.01)

(58) Field of Classification Search
CPC ............. C12Q 1/686; C12Q 2525/161; C12Q 2537/143
See application file for complete search history.

(56) References Cited

U.S. PATENT DOCUMENTS

| 6,207,372 | B1 | 3/2001 | Shuber |
| 6,890,741 | B2 | 5/2005 | Fan et al. |
| 7,510,829 | B2 | 3/2009 | Faham et al. |
| 7,695,941 | B2 | 4/2010 | Lin et al. |
| 8,999,642 | B2 | 4/2015 | Sabot et al. |
| 9,328,378 | B2 | 5/2016 | Earnshaw et al. |
| 9,523,121 | B2 | 12/2016 | Spier et al. |
| 9,605,305 | B2 | 3/2017 | Wang et al. |
| 2004/0224352 | A1 | 11/2004 | Fan et al. |
| 2010/0009412 | A1* | 1/2010 | Reynolds |
| 2010/0311064 | A1 | 12/2010 | Oliphant et al. |
| 2016/0060621 | A1 | 3/2016 | Agresti et al. |

FOREIGN PATENT DOCUMENTS

| EP | 0731177 A2 | 9/1996 | |
| EP | 2702170 B1 | 12/2015 | |
| WO | WO-2012112804 A1 * | 8/2012 | ......... C12N 15/1075 |
| WO | 2013081755 A1 | 6/2013 | |
| WO | 2020056004 A1 | 3/2020 | |
| WO | 2020056004 A8 | 6/2020 | |

OTHER PUBLICATIONS

Richards, "Multiplex PCR amplification from the CFTR gene using DNA prepared from buccal brushes/swabs," Human Molecular Genetics, vol. 2, No. 2, pp. 159-163. (Year: 1993).*
Invitation to Pay Additional Fees and, Where Applicable, Protest Fee for International Application No. PCT/US2019/050616, Mailed Nov. 14, 2019, 3 pgs.
International Preliminary Report on Patentability for International Application PCT/US2019/050616, Report issued Mar. 9, 2021, Mailed Mar. 25, 2021, 7 pgs.
International Search Report and Written Opinion for International Application No. PCT/US2019/050616, Search completed Jan. 6, 2020, Mailed Jan. 16, 2020, 14 pgs.
"Multiplexed Sequencing with the Illumina Genome Analyzer System", Illumina, Inc., Dec. 2, 2008, 4 pgs.
Abel et al., "Detection of structural DNA variation from next generation sequencing data: a review of informatic approaches", Cancer Genetics, vol. 206, No. 12, Dec. 2013, pp. 432-440, doi: 10.1016/j.cancergen.2013.11.002.
Abou Tayoun et al., "A Comprehensive Assay for CFTR Mutational Analysis Using Next-Generation Sequencing", Clinical Chemistry, vol. 59, No. 10, Oct. 1, 2013, pp. 1481-1488, https://doi.org/10.1373/clinchem.2013.206466.
Andreson et al., "Genomemasker package for designing unique genomic PCR primers", BMC Bioinformatics, vol. 7, No. 172, Mar. 27, 2006, 11 pgs., doi:10.1186/1471-2105/7/172.
Baker et al., "Improving newborn screening for cystic fibrosis using next-generation sequencing technology: a technical feasibility study", Genetics in Medicine, vol. 18, Feb. 12, 2015, pp. 231-238, doi:10.1038/gim.2014.209.
Berg et al., "Newborn Sequencing in Genomic Medicine and Public Health", Pediatrics, vol. 139, No. 2, Feb. 2017, 13 pgs., doi:10.1542/peds.2016-2252.

(Continued)

*Primary Examiner* — Young J Kim
(74) *Attorney, Agent, or Firm* — KPPB LLP

(57) ABSTRACT

Systems and methods of performing multiplex PCR on low and ultra-low quantities of starting template using custom primer sequences having a homotag. In some embodiments, these primers are capable of amplifying over 100 targets simultaneously and/or are capable of amplifying targets from low quantities of starting template. Along with these primers, sequencing methods are provided capable of sequencing the targets from numerous individuals, simultaneously. Additionally, methods for analyzing the sequencing results to advance treating an individual are provided.

7 Claims, 15 Drawing Sheets

Specification includes a Sequence Listing.

(56) References Cited

OTHER PUBLICATIONS

Bhattacharjee et al., "Development of DNA Confirmatory and High-Risk Diagnostic Testing for Newborns Using Targeted Next-Generation DNA Sequencing", Genetics in Medicine, vol. 17, Sep. 25, 2014, pp. 337-347, doi:10.1038/gim.2014.117.
Bonini et al., "Small-scale high-throughput sequencing-based identification of new therapeutic tools in cystic fibrosis", Genetics in Medicine, vol. 17, Jan. 8, 2015, pp. 796-806, doi:10.1038/gim.2014.194.
Brownie et al., "The elimination of primer-dimer accumulation in PCR", Nucleic Acids Research, Aug. 1, 1997, vol. 25, No. 16, pp. 3235-3241, https://doi.org/10.1093/nar/25.16.3235.
Cantarel et al., "Analysis of archived residual newborn screening blood spots after whole genome amplification", BMC Genomics, vol. 16, No. 602, Aug. 13, 2015, 6 pgs., DOI 10.0086/s12864-015-1747-2.
Chace et al., "Use of Tandem Mass Spectrometry for Multianalyte Screening of Dried Blood Specimens from Newborns", Clinical Chemistry, vol. 49, No. 11, Nov. 1, 2003, pp. 1797-1817, doi: https://doi.org/10.1373/clinchem.2003.022178.
Depristo et al., "A framework for variation discovery and genotyping using next-generation DNA sequencing data", Nature Genetics, vol. 43, Apr. 10, 2011, pp. 491-498, doi:10.1038/ng.806.
Feng et al., "Improved molecular diagnosis by the detection of exonic deletions with target gene capture and deep sequencing", Genetics in Medicine, Feb. 2015, vol. 17, No. 2, advanced online publication Jul. 17, 2014, pp. 99-107, coi:10.1038/gim.2014.80.
Garrison et al., "Haplotype-based variant detection from short-read sequencing", https://arxiv.org/pdf/1207.3907v2, Jul. 20, 2012, 9 pgs.
Hantash et al., "A large deletion in the CFTR gene in CBAVD", Genetics in Medicine, vol. 8, No. 2, Feb. 2006, pp. 93-95, doi: 10.107/01.gim.0000200945.54234.d7.
Hollegaard et al., "Archived neonatal dried blood spot samples can be used for accurate whole genome and exome-targeted next-generation sequencing", Molecular Genetics and Metabolism, vol. 110, No. 1-2, Sep.-Oct. 2013, pp. 65-72, http://dx.doi.org/10.1016/j.ymge.2013.06.004.
Lefterova et al., "Next-Generation Molecular Testing of Newborn Dried Blood Spots for Cystic Fibrosis", The Journal of Molecular Diagnostics, vol. 18, No. 2, Mar. 1, 2016, pp. 267-282, http://dx.doi.org/10.1016/j.moldx.2015.11.005.
Mamanova et al., "Target-enrichment strategies for next-generation sequencing", Nature Methods, Feb. 2010, vol. 7, pp. 111-118, published online Jan. 28, 2010, corrected after print Apr. 12, 2010, doi: 10.1038/nmeth.1419.
Peng et al., "Combining newborn metabolic and DNA analysis for second-tier testing of methylmalonic acidemia", Genetics in Medicine, Sep. 13, 2018, vol. 21, pp. 896-903, https://doi.org/10.1038s41436-018-0272-5.
Plagnol et al., "A robust model for read count data in exome sequencing experiments and implications for copy number variant calling", Bioinformatics, vol. 28, No. 21, Nov. 1, 2012, pp. 2747-2754, doi: https://doi.org/10.1093/bioinformatics/bts526.
Poulsen et al., "High-Quality Exome Sequencing of Whole Genome Amplified Neonatal Dried Blood Spot DNA", PLoS One, vol. 11, No. 4, e0153253, Apr. 18, 2016, 13 pgs., doi: https://doi.org/10.1371/journal.pone.0153253.

Schouten et al., "Relative quantification of 40 nucleic acid sequences by multiplex ligation-dependent probe amplification", Nucleic Acids Research, vol. 30, No. 12, Jun. 15, 2002, 13 pgs., https://doi.org/10.1093/nar/gnf056.
Schrijver et al., "Multiplex Ligation-Dependent Probe Amplification Identification of Whole Exon and Single Nucleotide Deletions in the CFTR Gene of Hispanic Individuals with Cystic Fibrosis", Journal of Molecular Diagnostics, vol. 10, No. 4, Jul. 2008, pp. 368-375, doi: 10.2353/jmoldx.2008.080004.
Shen et al., "Multiplex target capture with double-stranded DNA probes", Genome Medicine, vol. 5, No. 50, May 29, 2013, 8 pgs., http://genomemedicine.com/content/8/5/50.
Tan et al., "Transplant Virus Detection Using Multiplex Targeted Sequencing", The Journal of Applied Laboratory Medicine, vol. 2, No. 5, Mar. 2018, pp. 757-769, doi: https://doi.org/10.1373/jalm.2017.024521.
Trujillano et al., "Next generation diagnostics of cystic fibrosis and CFTR-related disorders by targeted multiplex high-coverage resequencing of CFTR", Journal of Medical Genetics, 2013, vol. 50, No. 7, published online first May 17, 2013, pp. 455-462, doi:10.1136/jmedgenet-2013-101602.
Turgeon et al., "Combined Newborn Screening for Succinylacetone, Amino Acids, and Acylcarnitines in Dried Blood Spots", Clinical Chemistry, vol. 54, No. 4, Apr. 1, 2008, pp. 657-664, doi: https://doi.org/10.1373/clinchem.2007.101949.
Waisbren et al., "Effect of Expanded Newborn Screening for Biochemical Genetic Disorders on Child Outcomes and Parental Stress", JAMA, vol. 290, No. 19, Nov. 19, 2003, pp. 2564-2572, doi:10.1001/jama.290.19.2564.
Wang et al., "Annovar: functional annotation of genetic variants from high-throughput sequencing data", Nucleic Acids Research, 2010, vol. 38, No. 16, e164, 7 pgs., published online Jul. 3, 2010, doi:10.1093/nar/gkq603.
Watson et al., "Newborn Screening: Toward a Uniform Screening Panel and System—Executive Summary", Pediatrics, vol. 117, Supplement 3, No. 5, May 2006, pp. S296-S307, doi: https://doi.org/10.1542/peds.2005-2633.
Wen et al., "Universal Multiplex PCR: a novel method of simultaneous amplification of multiple DNA fragments", Plant Methods, vol. 8, No. 32, Aug. 15, 2012, 9 pgs., http://www.plantmethods.com/content/8/1/32.
Wilson et al., "A Rapid, High-Quality, Cost-Effective, Comprehensive and Expandable Targeted Next-Generation Sequencing Assay for Inherited Heart Diseases", Circulation Research, vol. 117, No. 7, Sep. 11, 2015, pp. 603-611, doi:https://doi.org/10.1161/CIRCRESAHA.115.306723.
Xu et al., "A Novel Universal Primer-Multiplex-PCR Method with Sequencing Gel Electrophoresis Analysis", PLOS ONE, vol. 7, No. 1, Jan. 17, 2012, 10 pgs., doi: https://doi.org/10.1371/journal.pone.0022900.
Zheng et al., "Anchored multiplex PCR for targeted next-generation sequencing", Nature Medicine, Nov. 10, 2014, vol. 20, pp. 1479-1484, doi:10.1038/nm.3729.
Lefterova et al., "Next-Generation Molecular Testing of Newborn Dried Blood Spots for Cystic Fibrosis", The Journal of Molecular Diagnostics, vol. 18, No. 2, Mar. 2016, pp. 267-282, doi: 10.1016/j.jmoldx.2015.11.005.
Wen et al., "Universal Multiplex PCR: a novel method of simultaneous amplification of multiple DNA fragments", Plant Methods, vol. 8, No. 32, 2012, pp. 1-9, doi: 10.1186/1746-4811-8-32.

* cited by examiner

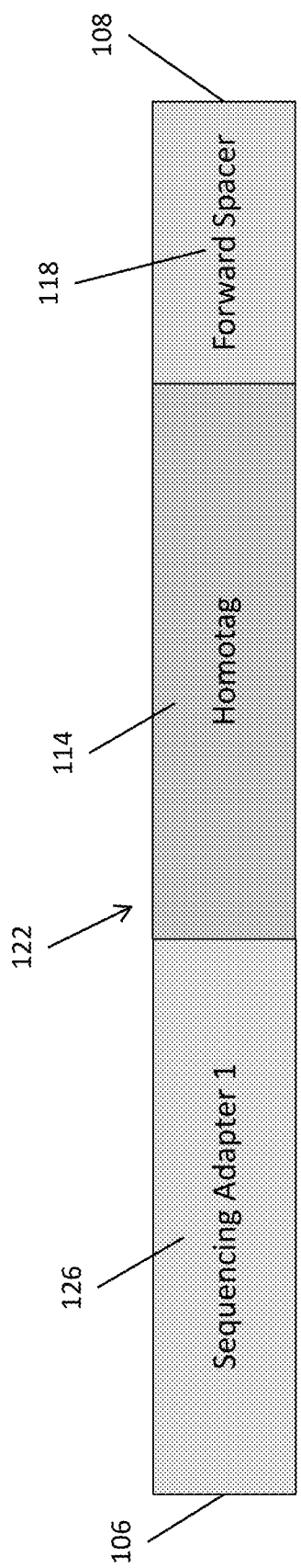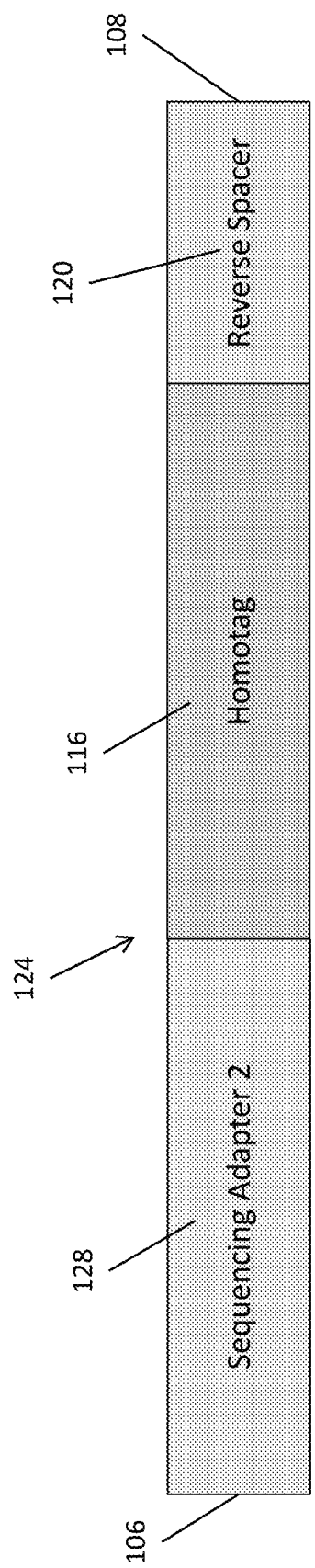
FIG. 4A
FIG. 4B

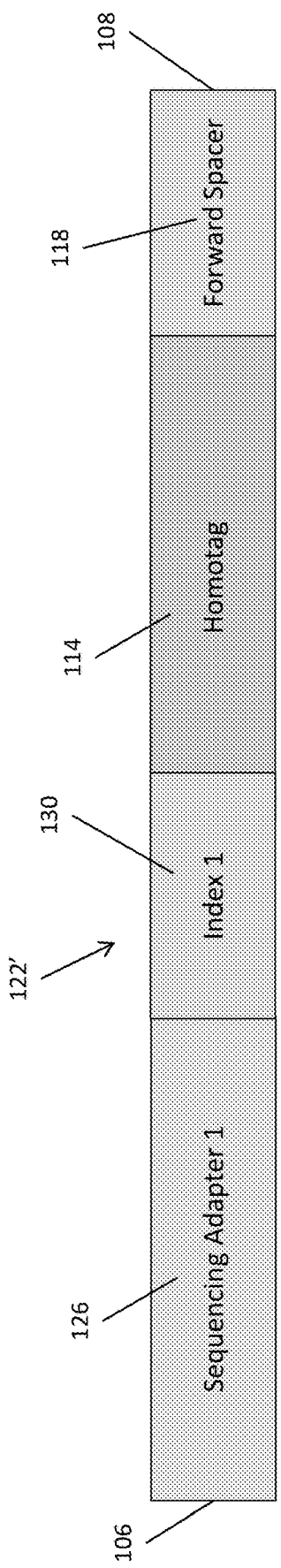
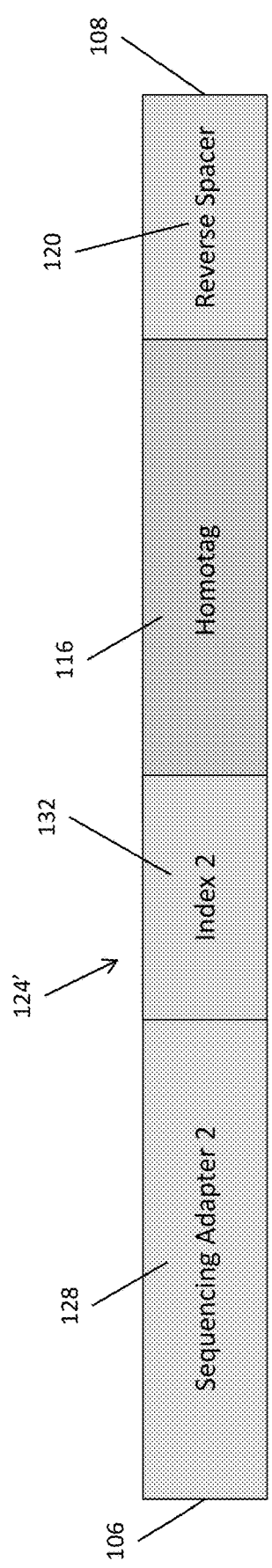
FIG. 4C
FIG. 4D

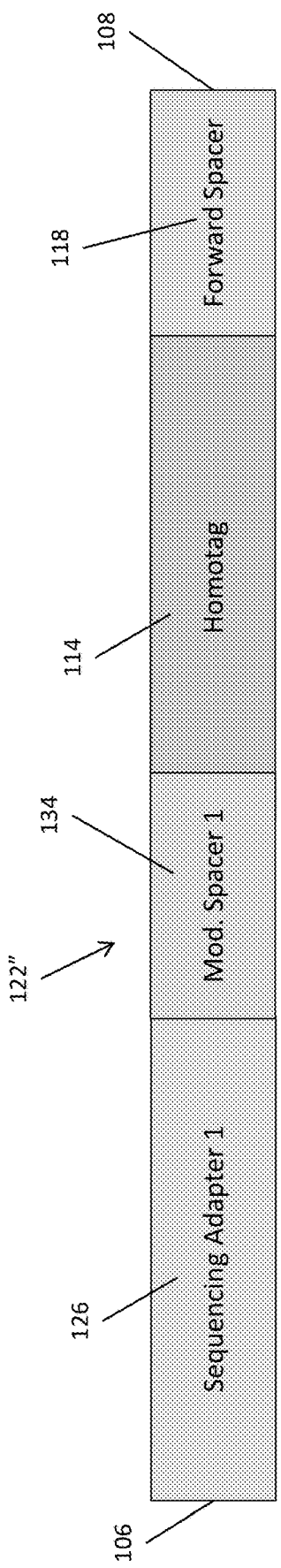
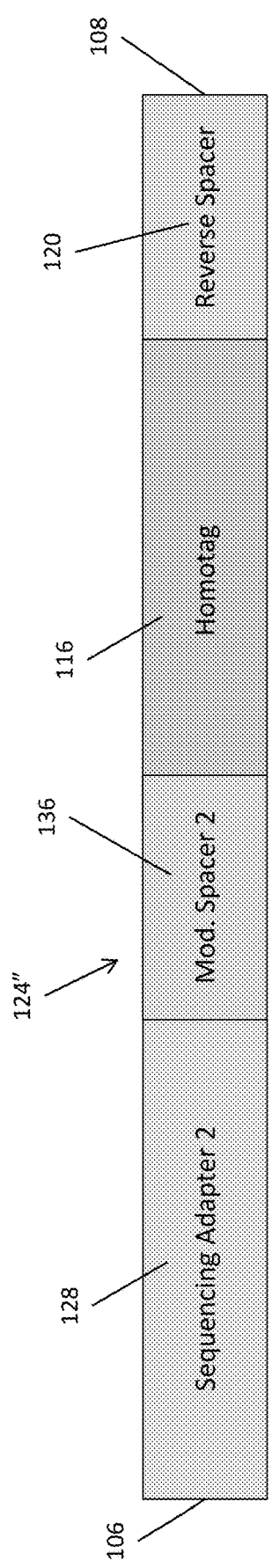
FIG. 5A
FIG. 5B

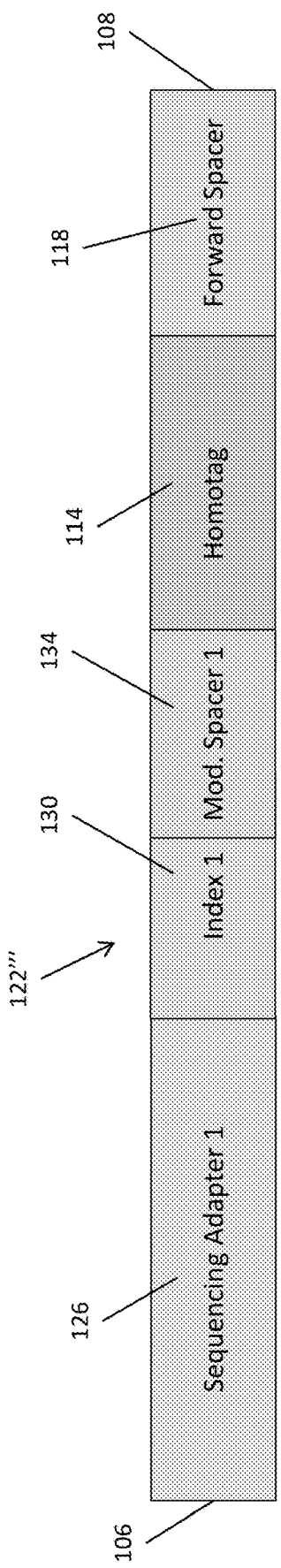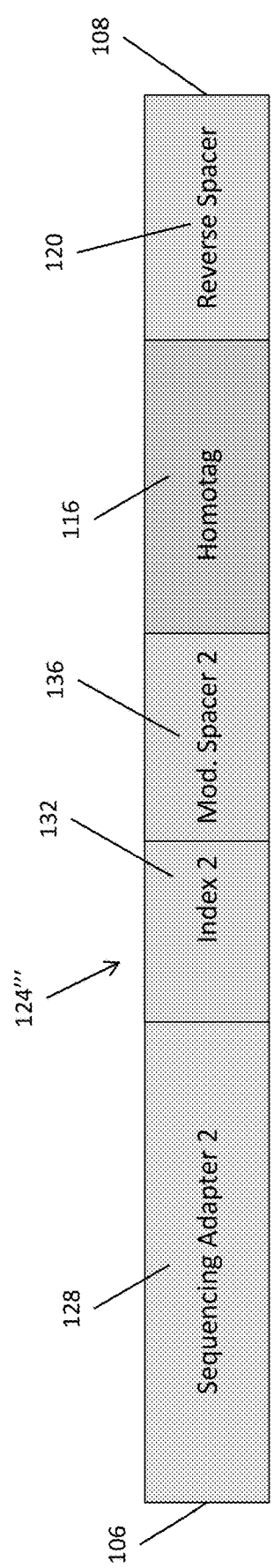
FIG. 5C
FIG. 5D

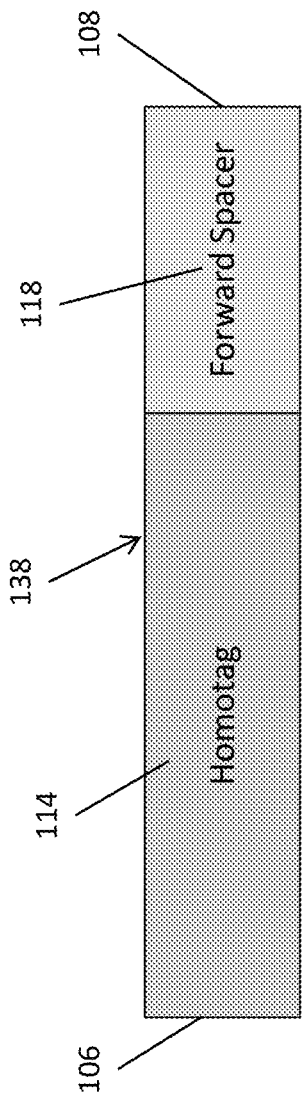
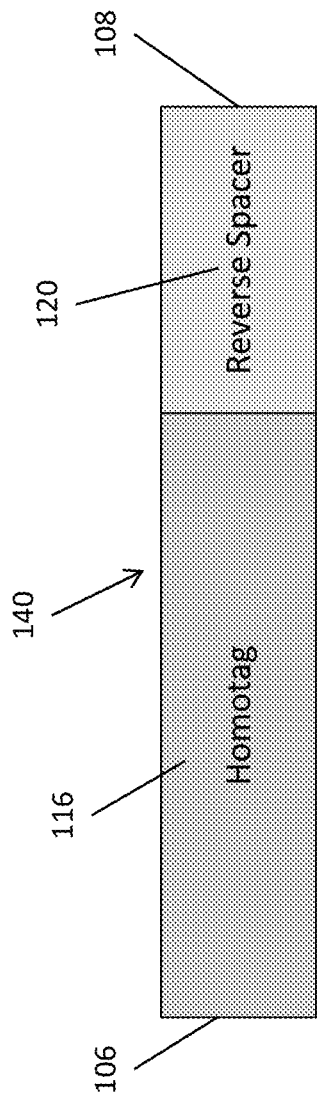
FIG. 6A
FIG. 6B

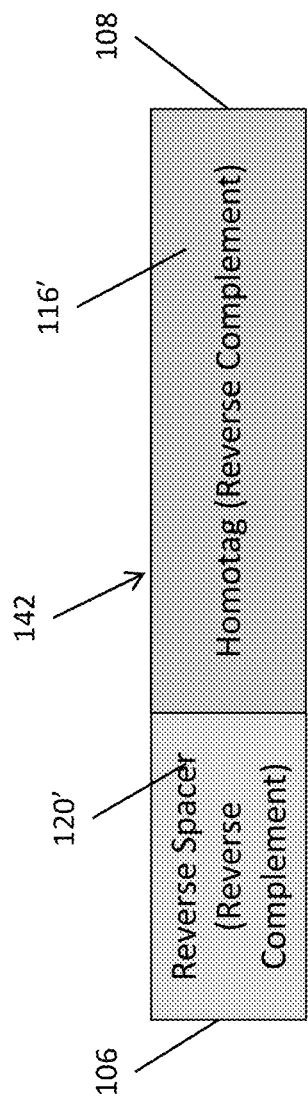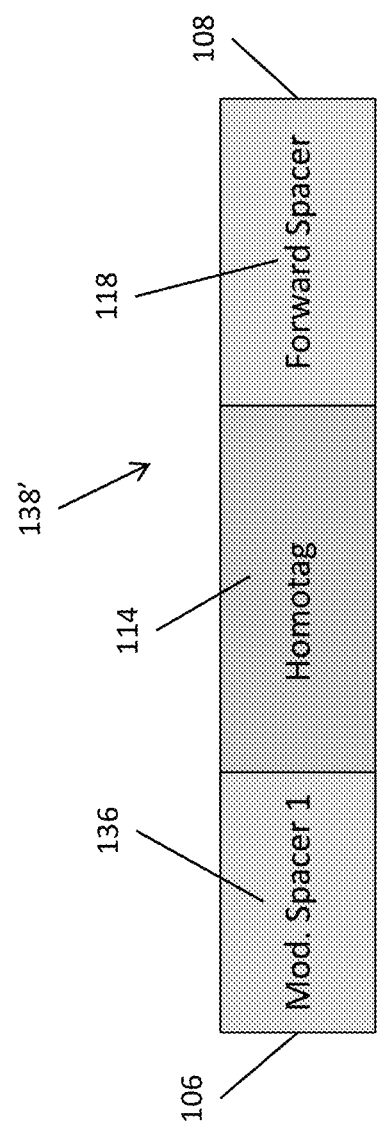

METHODS AND SYSTEMS FOR MULTIPLEX GENE AMPLIFICATION FROM ULTRA-LOW DNA INPUT AMOUNTS AND USES THEREOF

CROSS REFERENCE TO RELATED APPLICATIONS

This application is a national stage of PCT Patent Application No. PCT/US2019/050616, entitled "Methods and Systems for Multiplex Gene Amplification from Ultra-Low DNA Input Amounts and Uses Thereof" to Scharfe et al., filed Sep. 11, 2019, which claims priority to U.S. Provisional Application Ser. No. 62/729,921, entitled "Multiplex Gene Sequencing From Ultra-Low DNA Input Amounts" to Scharfe et al., filed Sep. 11, 2018; the disclosure of which are incorporated herein by reference in their entireties.

STATEMENT REGARDING FEDERALLY SPONSORED RESEARCH OR DEVELOPMENT

This invention was made with Governmental support under Grant No. HD081355 awarded by the National Institute of Health. The government has certain rights in the invention.

SEQUENCE LISTING

This application hereby incorporates by reference the material of the electronic Sequence Listing filed concurrently herewith. The material in the electronic Sequence Listing is submitted as a text (.txt) file entitled "06034_Sequences_ST25.txt" created on Aug. 1, 2019, which has a file size of 876 KB, and is herein incorporated by reference in its entirety.

FIELD OF THE INVENTION

The present invention is directed to polymerase chain reactions (PCR) and applications thereof, more particularly, multiplex PCR methods that allow for simultaneous amplification of multiple target sequences from ultra-low amounts of template nucleic acids.

BACKGROUND OF THE INVENTION

PCR is a commonly used method in biology and medicine for a number of purposes, including mutation detection, identification of individuals, diagnostic testing, genotyping, and nucleic acid sequencing. Current methods typically can only amplify a limited number of target sequences at a time and require large quantities of high-quality starting template (DNA or RNA). Unfortunately, many biological samples, including dried blood spots, possess low quantities of nucleic acids and can be of limited quality, which makes PCR on these samples difficult and nearly impossible for amplifying multiple targets simultaneously. As such, a need in the art exists to develop systems and methods that enable amplification of multiple target sequences in low quality and/or quantity DNA samples.

SUMMARY OF THE INVENTION

Systems and methods for multiplex nucleic acid amplification in accordance with embodiments of the invention are disclosed. In one embodiment, a composition for performing PCR includes a universal primer and a plurality of primer pairs, wherein each primer pair comprises a forward primer and a reverse primer, wherein the forward and the reverse primer comprises a general 5'-A-B-3' structure, where A represents the universal primer sequence and B represents a target specific sequence.

In a further embodiment, the universal primer possesses a melting temperature of approximately 69° C. to approximately 72° C.

In another embodiment, the plurality of primer pairs is at least 50 primer pairs.

In a still further embodiment, the plurality of primer pairs is at least 500 primer pairs.

In still another embodiment, the forward primers and reverse primers further comprise a spacer sequence, C, wherein the forward and reverse primers comprise a general 5'-A-C-B-3' structure.

In a yet further embodiment, the spacer in each forward primer consists of the sequence TCTG and the spacer in each reverse primer consists of the sequence AGAC.

In yet another embodiment, the universal primer and the plurality of primer pairs are at a ratio of 10:1.

In a further embodiment again, the universal primer sequence is SEQ ID: 2818.

In another embodiment again, the target specific sequence for each forward primer in the plurality of forward primers is selected from the group consisting of SEQ ID NOs: 940-1878, and each reverse primer in the plurality of forward primers is selected from the group consisting of SEQ ID NOs: 1879-2817.

In a further additional embodiment, a method of targeted sequencing of an individual, includes the steps of amplifying a plurality of target sequences in a sample using a first PCR reaction to create amplicons containing a universal primer sequence, wherein the first PCR reaction contains a universal primer, a plurality of forward primers, and a plurality of primer pairs, wherein each primer pair comprises a forward primer and a reverse primer, wherein the forward and the reverse primer comprises a general 5'-A-B-3' structure, where A represents the universal primer sequence and B represents a target specific sequence, generating a sequencing library from the amplicons using a second PCR reaction, wherein the second PCR reaction contains sequencing adapter primers comprising a general 5'-D-A-3' structure, where D represents a sequencing adapter sequence and A represents the universal primer sequence, and sequencing the sequencing library on a sequencing platform.

In another additional embodiment, the method includes obtaining a sample.

In a still yet further embodiment, the sample is a dried blood spot.

In still yet another embodiment, the forward primers, reverse primers, and sequencing adapter primers further comprise a spacer sequence, C, wherein the forward and reverse primers comprise a general 5'-A-C-B-3' structure and the sequencing adapter primers comprise a general 5'-D-A-C-3' structure.

In a still further embodiment again, the universal primer possesses a melting temperature of approximately 69° C. to approximately 72° C.

In still another embodiment again, the universal primer and the plurality of primer pairs are at a ratio of 10:1.

In a still further additional embodiment, the universal primer sequence is SEQ ID: 2818.

In still another additional embodiment, the plurality of primer pairs is at least 50 primer pairs.

In a yet further embodiment again, the plurality of primer pairs is at least 500 primer pairs.

In yet another embodiment again, the target specific sequence for each forward primer in the plurality of forward primers is selected from the group consisting of SEQ ID NOs: 940-1878, and each reverse primer in the plurality of forward primers is selected from the group consisting of SEQ ID NOs: 1879-2817.

In a yet further additional embodiment, the sequencing adapter sequence is selected from the group consisting of SEQ ID NOs: 2819-2820.

BRIEF DESCRIPTION OF THE DRAWINGS

These and other features and advantages of the present invention will be better understood by reference to the following detailed description when considered in conjunction with the accompanying drawings where:

FIGS. 4A-4D illustrate primer sequences for a PCR reaction to generate sequencing libraries in accordance with embodiments.

FIGS. 5A-5D illustrate primer sequences for a PCR reaction to generate sequencing libraries in accordance with embodiments.

FIGS. 6A-6C illustrate sequencing reaction primers in accordance with embodiments.

FIGS. 7A-7C illustrate sequencing reaction primers in accordance with embodiments.

DETAILED DISCLOSURE OF THE INVENTION

Figure 1:
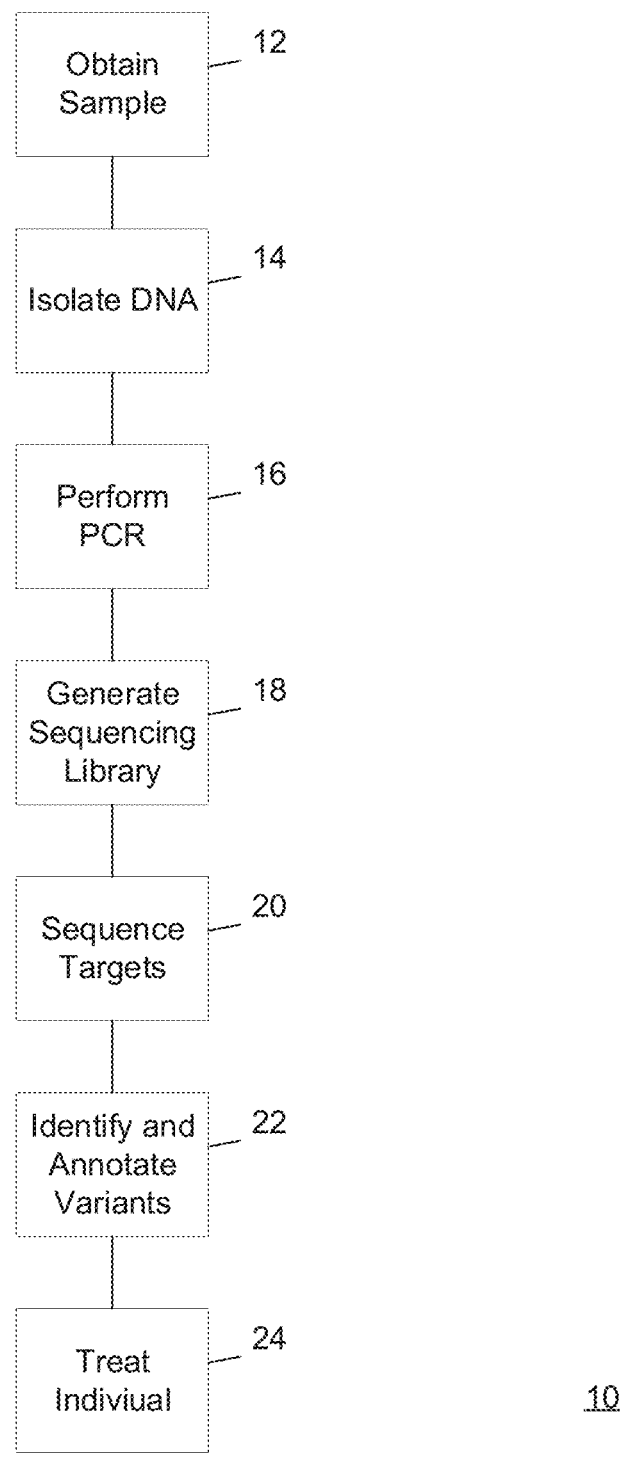
FIG. 1 illustrates a method for obtaining a sample and treating an individual in accordance with embodiments.

The present disclosure may be understood by reference to the following detailed description, taken in conjunction with the drawings as described below. It is noted that, for purposes of illustrative clarity, certain elements in various drawings may not be drawn to scale.

In accordance with the provided disclosure and drawings, systems and methods of performing multiplex PCR on low and ultra-low quantities of starting template using custom primer sequences having a homotag. In some embodiments, these primers are capable of amplifying over 100 targets simultaneously and/or are capable of amplifying targets from low quantities of starting template. Along with these primers, sequencing methods are provided capable of sequencing the targets from numerous individuals, simultaneously. Additionally, methods for analyzing the sequencing results to advance treating an individual are provided.

Traditional genetic testing or screening typically assesses an individual's genetics via hybridization, PCR, or sequencing. In hybridization panels, an individual's DNA is hybridized to a panel of known variants or mutations to identify which variants the individual possesses. While these panels can typically screen for a large number of targets, the panels are limited in that they can only identify variants that have previously been described and/or identified and cannot identify novel or previously unknown variants and can be limited in the ability to detect structural variation.

Similarly, PCR-based methods are typically limited to known variants but also has a number of problems that arise when amplifying multiple targets within a single reaction, including the increased levels of primers needed for the amplification of each target. With the addition of each target sequence, two additional primers need to be added the reaction. Adding additional primers to a reaction increases the likelihood of forming primer dimers or off-target amplification in the reaction, thus inhibiting amplification of the correct target. One solution has been to add additional template nucleic acid (either DNA or RNA) to the sample to increase the likelihood that the primers will amplify the correct sequence. Another solution is to reduce the concentration of the primers, but this strategy suggests a reduction in PCR sensitivity. Current methods of multiplex PCR have only resulted in amplification of a limited number (e.g., less than about 20) of individual targets in a single reaction. Embodiments herein describe a methods and systems to amplify large numbers of target sequences, including amplifying greater than 100, 200, 300, 400, 500, 600, 700, 800, 900, or 1000 targets in a single PCR reaction. Further embodiments are directed to methods of sequencing the amplified targets.

Additionally, some biological samples are limited in quantity and/or lack large quantities of DNA or RNA, thus limiting the ability for an individual to amplify multiple targets in a single reaction. For example, dried blood spots (DBSs) are regularly taken from babies shortly after birth. DBSs provide a chance to assess newborns for genetic health defects, disorders, or diseases at a very early time point, which may be important for early life care. However, DBS samples contain only small and varying amounts of blood, thus the nucleic acid content within a DBS is limited. Adding multiple primer pairs to a reaction with limited input template would quickly overwhelm in the input template and increase the likelihood of primer dimers or other inhibiting structures.

Finally, sequencing is a great alternative by providing full sequence reads and identification of novel variants that could be missing from other panels. However, in genetic testing, typically only a panel of genes or genetic elements are relevant, thus whole genome sequencing would reveal much additional data that may not have any effect on underlying diseases or conditions in an individual. Traditional targeted sequencing typically utilizes a combination of hybridization and PCR to isolate and amplify a subset of targets with added costs in reagents, labor, and equipment. Thus, there exists a need in the art for PCR-based panels to amplify a large number of sequences to reduce costs and improve genetic screening, especially with samples containing low amounts of nucleic acids.

An example of a targeted panel of genes is the Recommended Universal Screening Panel (RUSP), which can detect more than forty metabolic disorders that have historically caused significant morbidity and mortality in children. (See American College of Medical Genetics Newborn Screening Expert G. Newborn screening: toward a uniform screening panel and system—executive summary. Pediatrics. 2006; 117(5 Pt 2): 5296-307; and Urv T K, Parisi M A. Newborn Screening: Beyond the Spot. Adv Exp Med Biol. 2017; 1031:323-346; the disclosures of which are incorporated herein by reference in their entireties.) However, typical RUSP assays in newborns uses tandem mass spectrometry (MS/MS). (See Carreiro-Lewandowski E. Newborn screening: an overview. Clin Lab Sci. 2002; 15(4):229-238; Chace D H, Kalas T A, Naylor E W. Use of tandem mass spectrometry for multianalyte screening of dried blood specimens from newborns. Clinical chemistry. 2003; 49(11): 1797-1817; and Turgeon C, Magera M J, Allard P, et al.

Combined newborn screening for succinylacetone, amino acids, and acylcarnitines in dried blood spots. Clinical chemistry. 2008; 54(4):657-664; the disclosures of which are incorporated herein by reference in their entireties.) While beneficial in most respects, MS/MS screening is tuned to maximize the number of newborns identified, with sensitivity favored over specificity. This approach increases the number of false-positive results, leading to considerable emotional and financial burdens of follow-up testing, unneeded medical precautions for false-positive cases and diagnostic delays for some infants. (See Waisbren S E, et al. Effect of expanded newborn screening for biochemical genetic disorders on child outcomes and parental stress. JAMA. 2003; 290(19):2564-2572; the disclosure of which is incorporated herein by reference in its entirety.) To reduce the number of false-positive cases without compromising sensitivity, screen-positive results are followed by second-tier testing at higher specificity. (See Matern D, et al. Reduction of the false-positive rate in newborn screening by implementation of MS/MS-based second-tier tests: the Mayo Clinic experience (2004-2007). Journal of inherited metabolic disease. 2007; 30(4):585-592; the disclosure of which is incorporated herein by reference in its entirety.) As such, second-tier tests measure more specific disease markers (e.g., organic acids) to confirm (true positive) or reject (false positive) the primary screen result. Second-tier tests are typically not part of the primary screen due to assay complexity, limited throughput, analysis time and cost. (See e.g., Chace D H, Hannon W H. Impact of second-tier testing on the effectiveness of newborn screening. Clinical chemistry. 2010; 56(11):1653-1655; the disclosure of which is incorporated herein by reference in its entirety.) However, both primary and secondary screening utilizes the original newborn DBS to avoid a new blood draw and minimize turnaround time.

The advent of rapid, inexpensive next-generation sequencing (NGS) promises to revolutionize newborn screening. (See e.g., Berg J S, et al. Newborn Sequencing in Genomic Medicine and Public Health. Pediatrics. 2017; 139(2); the disclosure of which is incorporated herein by reference in its entirety.) Incorporating NGS-based analysis at the earliest stage in the screening process could drastically streamline the diagnostic work-up following an abnormal NBS result, but has several challenges. Previous studies using residual DBS for NGS either required large amounts of DBS material, or used whole-genome amplification for sequence library preparation. (See Hollegaard M V, et al. Archived neonatal dried blood spot samples can be used for accurate whole genome and exome-targeted next-generation sequencing. Molecular genetics and metabolism. 2013; 110 (1-2):65-72; Bhattacharjee A, et al. Development of DNA confirmatory and high-risk diagnostic testing for newborns using targeted next-generation DNA sequencing. Genetics in Medicine: official journal of the American College of Medical Genetics. 2015; 17(5):337-347; Cantarel B L, et al. Analysis of archived residual newborn screening blood spots after whole genome amplification. BMC genomics. 2015; 16:602; and Poulsen J B, et al. High-Quality Exome Sequencing of Whole-Genome Amplified Neonatal Dried Blood Spot DNA. PLoS One. 2016; 11(4):e0153253; the disclosures of which are incorporated herein by reference in their entireties.) A less expensive and more efficient approach is multiplex gene sequencing from DBS from a multiplex PCR reaction, using a panel of genes relevant to the specific disease(s) or biological condition(s) detected in primary newborn screening.

Current NGS diagnostics are suboptimal for NBS due to their inability to accommodate DBS-derived material. Newborn DBS samples contain only small and varying amounts of blood, from which multiple punches are taken for NBS for the various conditions on the panel. The small amount of dried blood remaining limits the amount of extractable DNA for use in second-tier testing. Previous studies using residual DBS for NGS either required large amounts of DBS material, or used whole-genome amplification for sequence library preparation. (See Hollegaard M V, et al. Archived neonatal dried blood spot samples can be used for accurate whole genome and exome-targeted next-generation sequencing. Molecular genetics and metabolism. 2013; 110 (1-2):65-72; Bhattacharjee A, et al. Development of DNA confirmatory and high-risk diagnostic testing for newborns using targeted next-generation DNA sequencing. Genetics in medicine: official journal of the American College of Medical Genetics. 2015; 17(5):337-347; Cantarel B L, et al. Analysis of archived residual newborn screening blood spots after whole genome amplification. BMC genomics. 2015; 16:602; and Poulsen J B, et al. High-Quality Exome Sequencing of Whole-Genome Amplified Neonatal Dried Blood Spot DNA. PLoS One. 2016; 11(4):e0153253; the disclosures of which are incorporated herein by reference in their entireties. A more efficient approach is multiplex gene sequencing from DBS, using a panel of genes relevant to the specific condition(s) detected in primary newborn screening, which is incorporated into numerous embodiments. Further Turning to FIG. 1, a method 10 is illustrated that incorporates numerous described herein and how many of the embodiments relate into a larger process. In particular, at Step 12, a sample is obtained. In numerous embodiments, the sample contains nucleic acids (e.g., DNA or RNA). In many embodiments, the sample is a blood sample. In some embodiments, the sample is a DBS. It should be noted that many different samples are known in the art.

At Step 14, DNA is isolated from the sample in numerous embodiments. The DNA may be isolated by any means known in the art that is sufficient for the specific tissue and/or source of the sample. Many embodiments will isolate DNA from a DBS using methods designed to yield the maximum quantity of nucleic acids possible. Methods for isolating DNA from DBSs according to many embodiments are described further in depth below.

At Step 16, a PCR reaction is performed in many embodiments. For some embodiments, the PCR reaction amplifies a single amplicon from the template nucleic acids isolated from the sample. In many embodiments, multiplex PCR reactions are performed to isolate many targets simultaneously. Additional embodiments will utilize unique sequences concatenated to target specific primers to increase amplicon efficiency. Additional details on primer design will be described in detail below.

At Step 18 of many embodiments, a sequencing library or target sequences is generated. In a number of embodiments, the sequencing library is generated using PCR. A sequence library in accordance with embodiments will add specific nucleic acid sequences to allow the target amplicons to be sequenced, such as adapter and index sequences. Numerous embodiments will append Illumina adapters to the amplicons generated from the PCR reaction of Step 16.

The library of target sequences will be sequenced at Step 20 of many embodiments. Many methods and platforms for sequencing nucleic acids are known in the art, many of which will be sufficient for sequencing libraries generated in embodiments herein. However, a number of embodiments will utilize an Illumina platform, such as a MiSeq, HiSeq, HiScan, iSeq, MiniSeq, NextSeq, NovaSeq, and/or any other Illumina platform.

Variants will be identified and annotated in the sequence of many embodiments at Step 22 of many embodiments. Numerous methods exist in the art for identifying variants, including GATK, Annovar, and many other available software packages and/or resources.

At Step 24, many embodiments will treat an individual based on the identified and annotated variants. In many embodiments, the treatments are known in the art for an affliction, condition, and/or disease identified at Step 22.

While the above method 10 contains a number of steps, not all steps are necessary to be performed in all embodiments. Additionally, method 10 is meant to illustrate a number of embodiments that stand alone as separate embodiments, which can be integrated into larger processes, methods, systems, kits, etc. Additionally, numerous embodiments may be able to perform some steps simultaneously, nearly simultaneously, and/or in an order that differs from what is illustrated in FIG. 1.

DNA Isolation

Many embodiments are directed to amplifying target sequences using DBS samples collected from individuals, including newborn babies. As noted above, DBS samples contain limited and varying quantities of DNA. As such, many embodiments isolate DNA from DBS in a method to maximize DNA yield. In some embodiments, one or more punches are taken from a DBS. In several embodiments, a single 3 mm punch is taken from a DBS from one individual. In various embodiments, the punch(es) are washed one or more times with 10 mM NaOH. In numerous embodiments, the punch(es) are suspended in a volume of 10 mM NaOH and heated to allow DNA to elute from the DBS. In various embodiments, the punch(es) is suspended in 50 μL of 10 mM. In certain embodiments, the punch(es) are heated for a period of 5, 10, 15, 20, or 30 minutes at 99° C. Various embodiments will mix and/or transfer the liquid, which contains isolated DNA, to a fresh tube for further processing.

Many embodiments will obtain samples from multiple individuals simultaneously. For example, punches can be taken from 96, 192, or 384 individuals simultaneously to allow DNA isolation using 96-well, 192-well, or 384-well plates.

Multiplex PCR Reactions

Figure 2A:
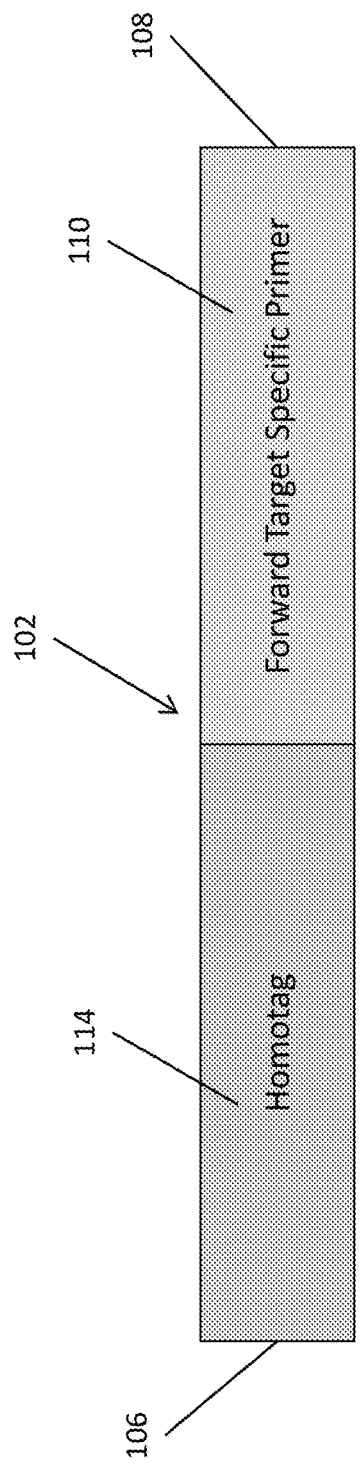
FIGS. 2A-2F illustrate primer sequences for a multiplex PCR reaction in accordance with embodiments.
Figure 2B:
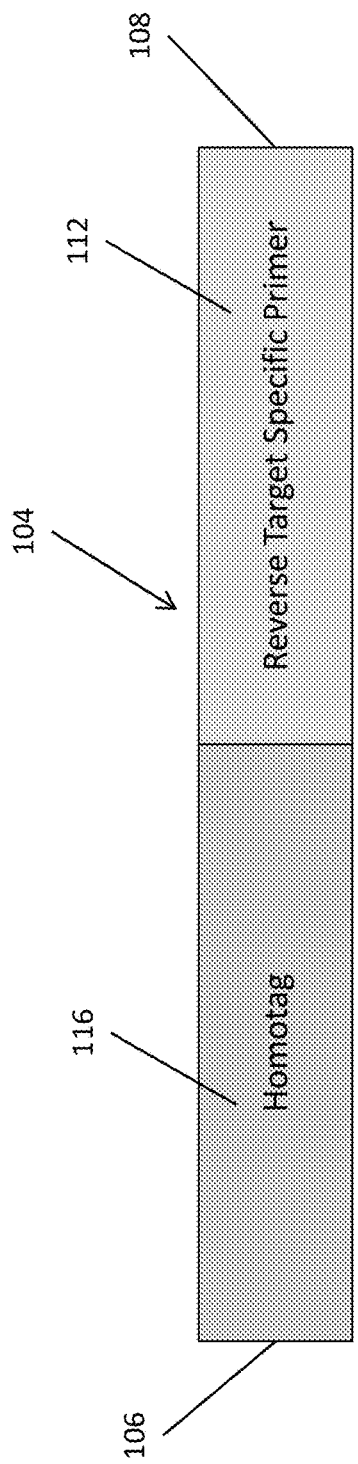

Many embodiments are directed to components and methods for performing PCR reactions. in accordance with many embodiments is described. Turning to FIGS. 2A-2B, forward 102 and reverse 104 PCR primers in accordance with many embodiments are illustrated. The primers 102, 104 start at the 5'-end 106 to the 3'-end 108 of each primer 102, 104. As with many PCR reactions, forward 110 and reverse 112 target specific primers are included in order to frame the target sequence and allow amplification of the target sequence from template nucleic acids. The amplified target molecules are referred to as amplicons. Additionally, homotags 114, 116 are attached at the 5'-ends 106 of the forward 102 and reverse 104 primers. A homotag in accordance with many embodiments is a universal primer that allows amplification of the amplicons independent of the target sequence. In many embodiments, the homotags 114, 116 that are part of the PCR primers 102, 104 possess the same sequence, thus allowing a single-primer amplification of target amplicons. In general, the structure of primers 102, 104 of many embodiments can be described as 5'-A-B-3', where A is a homotag 114, 116, and B is target specific primer 110, 112.

In a number of embodiments, the PCR primers 102, 104 will be designed to avoid aberrant amplification, off-target amplification, and/or other issues that may arise because of poor primer design. When designing PCR primers 102, 104, a number of methods can be utilized, including automation with available software packages. In several embodiments, target sequences, such as entire genes, regions, and/or other significant areas, will be analyzed to avoid problematic sequences, such as repetitive elements. Many of these embodiments will utilize repeat masking software, such as RepeatMasker to block off repetitive elements within these regions. For example, if an entire gene sequence is identified as a target sequence, the target sequence may include introns, exons, 5'-UTRs, 3'UTRs, in addition to other genetic elements. Some of these features can include repetitive sequences that can interfere with PCR if used as a target specific primer 110, 112. By masking these sequences, these regions will not be selected as target specific primers 110, 112. Once certain elements are masked, target specific primer 110, 112 will be designed in many embodiments. The primer design can be performed manually or automated using programs such as Primer3. When multiplexing PCR reactions, the target specific primers 110, 112 are designed to have similar characteristics, such as size, melting temperature, GC content, amplicon size of the resulting amplicon, and any combination thereof. In some embodiments, target specific primers 110, 112 will have an average size of approximately 20-30 base pairs (bp), and amplicon size of approximately 300-500 bp. In several embodiments, the target specific primers 110, 112 will range in size from 21-27 bp and have an average size of 23 bp and amplify targets ranging from 350-500 bp with an average size of 412 bp.

Once designed, the entire sequence of PCR primer 102, 104 can be established, including homotags 114, 116. Once fully designed, additional quality control metrics will be performed in a number of embodiments. For example, sequences for PCR primers 102, 104 can be assessed for primer-dimer formation that can interfere with PCR reactions. Methods for optimizing primer design include the AutoDimer software package to assess secondary structure and/or primer dimer formation within a selection of PCR primer. If primers are predicted to form primer dimers or other interfering structures, the target specific primer sequences 110, 112 can be adjusted and reassessed until primer dimers or other structures are minimized.

In many embodiments, a pool of PCR primers 102, 104 are added in a reaction, where the target specific primers 110, 112 differ for the various targets, but the homotags 114, 116 remain the same. In several embodiments, the PCR primers 102, 104 are tested and optimized to reduce amplicon dropout and/or non-specific amplification. This optimization can include rebalancing a pool of primers (raising or lowering the concentration of specific primer pairs) or by altering the characteristics of the target specific primers 110, 112. It should be noted that one of skill in the art is capable of identifying issues with PCR primers, including dropout and/or non-specific amplification, and would know how to rebalance and/or altering primers within a reaction. In a number of embodiments, primer pairs that amplicons with low GC content will be increased, while primer pairs that amplify amplicons with high GC content will be reduced.

In certain embodiments, the homotags 114, 116 are designed to have a different (e.g., higher or lower) melting temperature than the target specific primers 106, 108. By altering melting temperature of the homotags 114, 116, aberrant amplification is less likely to occur from the presence of the homotags 114, 116. Additional embodiments will design homotags 114, 116 to lack homology with sequences within the genome sequence of a sample to be amplified. Lacking homology with the sample's genome will aid in preventing aberrant or erroneous amplification. Many methods exist for determining which sequences possess or lack homology, including performing alignments of a particular sequence to the sample's reference genome sequence (e.g., using BLAT, BLAST, and/or any other alignment software) or querying a K-mer database. It should also be understood that lacking homology does necessarily not mean possessing no homology with a reference sequence but lacking sufficient homology to prevent amplification under particular PCR reaction conditions.

In numerous embodiments, the homotags 114, 116 will have a higher melting temperature. Having a higher melting temperature for the homotags 114, 116 will allow for amplification of all amplicons using homotag-specific primers without allowing the target specific primers 110, 112 to anneal to template nucleic acids. In such a circumstance, amplicon amplification will occur rather than template amplification—i.e., amplification will be based on amplicons containing homotag sequences rather than generating new amplicons from sample template. It should be noted that because nucleic acid amplification is directional from 5' to 3', homotag-specific primers will have the same sequence as the homotags 114, 116, such as illustrated in FIGS. 2E-2F, where the homotag-specific primers are only the homotag sequences 114, 116.

Figure 2C:
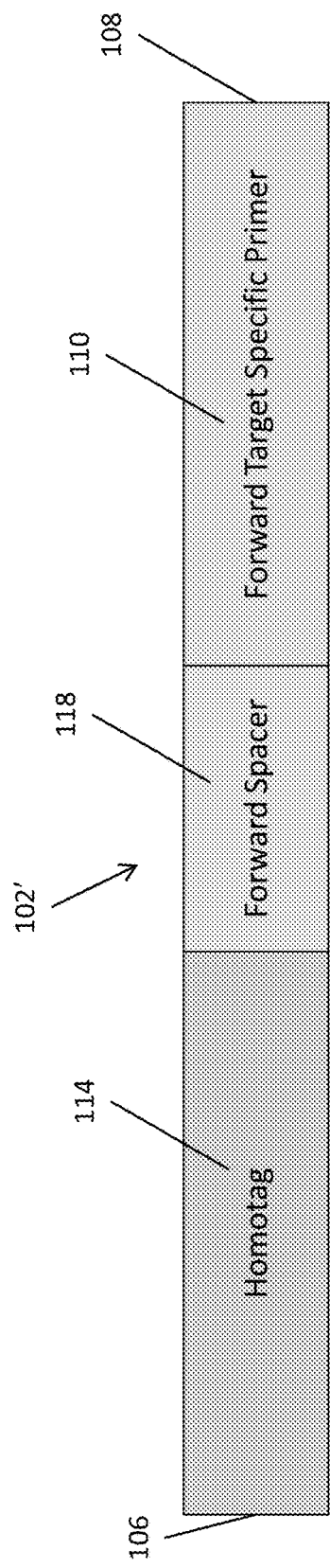
Figure 2D:
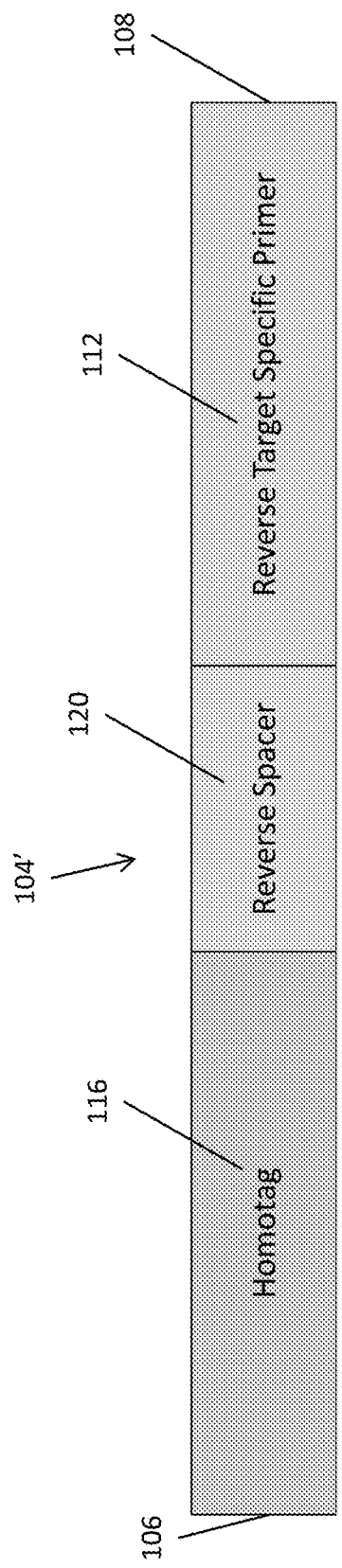
Figure 2E:
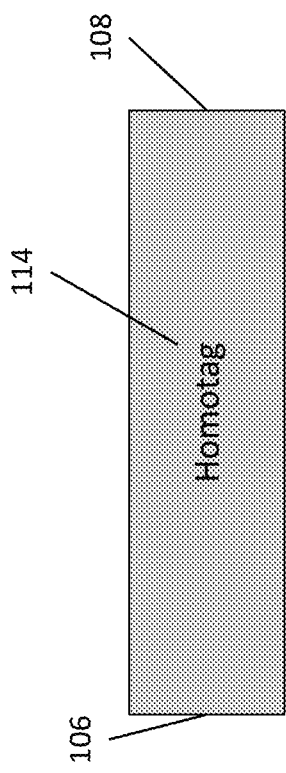
Figure 2F:
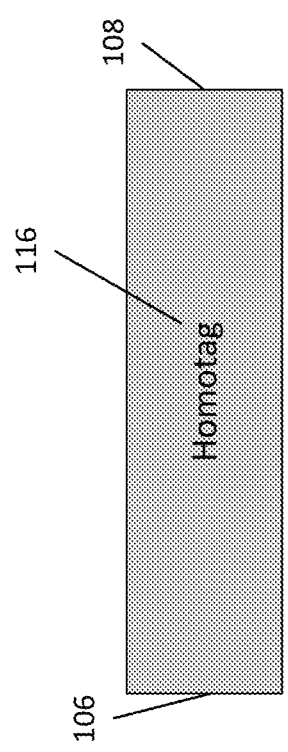

Turning to FIGS. 2C-2D, a number of embodiments will include forward 118 and reverse 120 spacer sequences between homotags 114, 116 and target specific primers 110, 112. Spacer sequences 118, 120 can be used to provide directionality into PCR primers 102', 104'. Spacer sequences 118, 120 can be of any length to allow differentiation in direction. In a number of embodiments, the spacer sequences are 4-8 bp long. In certain embodiments, the spacer sequences are 4 bp sequences. In embodiments including spacers, the primers 102', 104' can be described to have a general structure of 5'-A-C-B-3', where A is a homotag 114, 116, B is a target specific primer 110, 112, and C is a spacer 118, 120.

The RUSP panel contains 60 conditions including 34 core conditions and 26 secondary conditions. In a number of embodiments, the targets are selected based on the RUSP panel. In some embodiments, a panel of 72 genes are selected that include 64 genes associated with 46 different RUSP metabolic disorders and cystic fibrosis and an additional 8 genes associated with 7 metabolic disorders that are not currently in the RUSP metabolic disorders. Table 1 provides a list of conditions selected in some embodiments for use in many embodiments. The list in Table 1 includes conditions currently in the RUSP panel as well as additional conditions that will be selected in certain embodiments. In particular Table 1 identifies specific conditions in a RUSP panel by its ACMG code, the specific condition identified by that code, whether it is a core or secondary condition (if the condition is in the RUSP panel), condition type, genes and NCBI numbers for those genes that are associated with the condition, the current methodologies for determining the condition and the primary analyte for the analysis. Additional information regarding metabolic conditions can be found at www.hrsa.gov/advisory-committees/heritable-disorders/rusp/index.html; the disclosure of which is incorporated by reference in its entirety.

In a number of embodiments targeting the 72 genes as described in Table 2, the specific segments of these genes are selected as target amplicons. In many embodiments, the target amplicons are selected as all exons, flanking intronic regions, and key non-coding regions. In certain embodiments, the targeted amplicons are selected from the group consisting of SEQ ID NOs: 1-939. In a number of embodiments, forward target specific primers 110 are selected from SEQ ID NOs: 940-1878 and reverse target specific primers 112 are selected from SEQ ID NOs: 1879-2817. Table 2 lists specific target names and identifies SEQ ID NOs for the target sequence and correlating forward and reverse target specific primers, where the forward primer SEQ ID NO and the reverse primer SEQ ID NO in a row form a primer pair for the target sequence SEQ ID NO in that same row. For example, SEQ ID NO: 940 and SEQ ID NO: 1879 form a primer pair for SEQ ID NO: 1. It should be noted that the specific sequence for any of the target sequences SEQ ID NOs: 1-939 are only representative of the specific target to be amplified. In many embodiments, variants will exist within the target amplicon for a particular sample, thus one primer pair will amplify a target sequence with at least 75%, 80%, 85%, 90%, 95%, 96%, 97%, 98%, 99%, or 100% identity to a particular target sequence.

In certain embodiments, the homotag is SEQ ID NO: 2818. In some embodiments including spacers 118 and/or 120, the spacers are selected from the 5'-TCTG-3' and 5'-AGAC-3'. In several embodiments of directional PCR primers 102', 104' (e.g., primers including spacers 118, 120) the forward spacer is 5'-TCTG-3', and the reverse spacer is 5'-AGAC-3'. Thus, In many embodiments, the forward PCR primer 102 has a general structure of 5'-X-Y-Z-3', where X is SEQ ID NO: 2818, Y is TCTG, and Z is any one of SEQ ID NOs: 940-1878, and reverse PCR primer 104 has a general structure of 5'-X-Q-R-3', where X is SEQ ID NO: 2818, Q is AGAC, and R is any one of SEQ ID NOs: 1879-2817. Numerous embodiments will pool multiple versions of PCR primers 102 and 104 or directional PCR primers 102' and 104'.

An advantage having homotags 114, 116 with higher melting temperatures is that it will allow for a single reaction set up, which includes PCR primers 102, 104 or directional PCR primers 102', 104' along with homotag-specific primers 114, 116 within the same reaction tube or vessel. In such a circumstance, the reaction will comprise template nucleic acid (e.g., DNA and/or RNA), buffer, water, one or more forward primers, one or more reverse primer, a homotag-specific primer, nucleotide triphosphates (e.g., dNTPs and/or NTPs), a polymerase, and/or any other component known in the art to assist or promote PCR amplification. In many embodiments the pool PCR primers 102, 104 or directional PCR primers 102', 104' will be used at a total concentration of approximately 0.5 µM (e.g., ±0.5 µM), such that some embodiments will utilize 0.1 µM, 0.2 µM, 0.3 µM, 0.4 µM, 0.5 µM, 0.6 µM, 0.7 µM, 0.8 µM, 0.9 µM, or 1.0 µM of total PCR primers 102, 104 or directional PCR primers 102', 104'. The homotag-specific primer 114, 116 will be placed in the reaction tube at a concentration equal to or greater than the concentration of pooled PCR primers 102, 104 or directional PCR primers 102', 104'. As such, many embodiments will use a ratio of homotag-specific primers to PCR primers of 1:1, 2:1, 3:1, 4:1, 5:1, 6:1, 7:1, 8:1, 9:1, 10:1 or greater for the ratio of homotag-specific primers to PCR primers. Many embodiments will use a ratio of 10:1 homotag-specific primers to PCR primers, such that approximately 5 µM of homotag specific primers 114, 116 will be used in a reaction containing approximately 0.5 µM of pooled PCR primers 102, 104 or directional PCR primers 102', 104'.

Many embodiments are directed to DNA polymerization based on a DNA template, so these reactions will comprise a DNA template, buffer, at least one forward primer, at least one reverse primer, a homotag primer, dNTPs, and a polymerase. In many embodiments, the forward and reverse primers will possess a homotag sequence, such as those described herein. In many embodiments, the polymerase will be a DNA polymerase, such as Taq polymerase, while additional embodiments will utilize high fidelity polymerases, strand displacement polymerases, RNA polymerases, long-range polymerases, any other polymerase relevant to the type of reaction, and/or any combination thereof. Numerous embodiments will alter the temperature cycling of the reaction to include a first set of cycles with a lower annealing temperature to allow for template amplification followed by a second set of cycles with a higher annealing temperature to allow for amplicon amplification. For example, the first set of cycles will have an annealing temperature of approximately 50-69° C. followed by a second set of cycles with an annealing temperature of approximately 70-72° C. Additional embodiments will include manipulations to the sets of cycles, such as ramping, touch-down, or any other methodology for amplification. Some specific embodiments utilize the following profile:

95° C. for 3 minutes,
12 cycles of:
   95° C. for 16 seconds,
   69-52° C. for 2 minutes (reducing temperature by 1.5° C. per cycle),
   72° C. for 45 seconds,
10 cycles of:
   95° C. for 16 seconds,
   72° C. for 20 seconds,
   72° C. for 2 minutes.

While the above is described in relation to a single sample, many embodiments will utilize common reaction plates to allow PCR amplification from multiple samples obtained from multiple individuals simultaneously. For example, 96 individual samples can be kept in a standard 96-well plate, which would allow for multiplex PCR reactions to be performed on all 96 samples simultaneously.

Figure 3A:
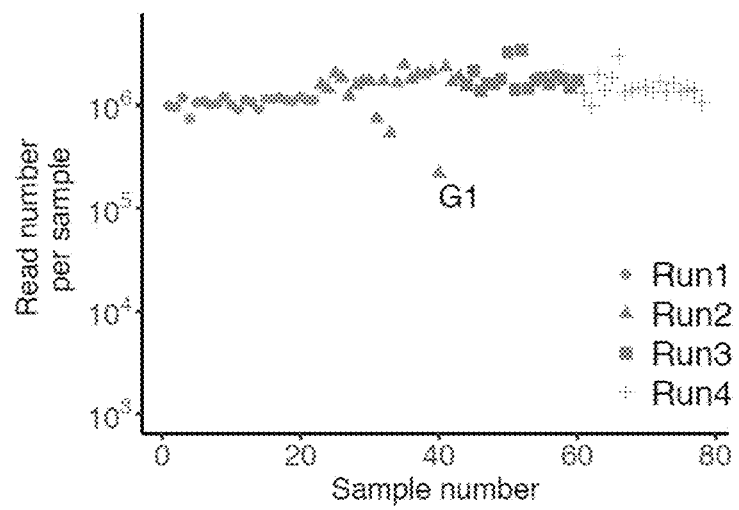
FIGS. 3A-3B illustrate results of multiplex PCR reactions in accordance with embodiments.
Figure 3B:
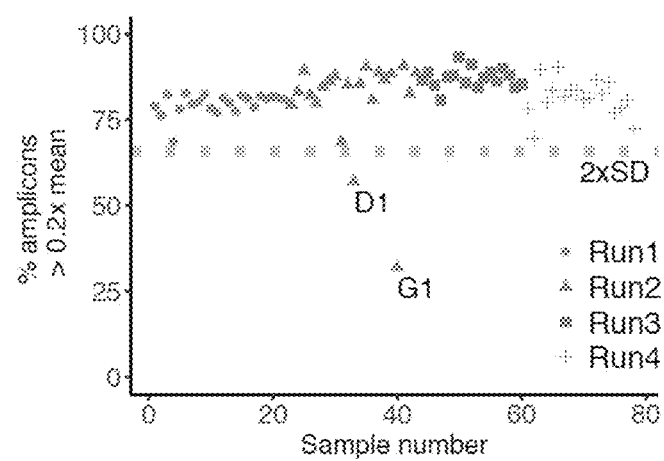

Turning to FIGS. 3A-3B, the success rates of amplifying 939 amplicons are illustrated in accordance with embodiments. Specifically, FIG. 3A illustrates the number of sequencing reads per sample, which indicates the overall success rate of numerous embodiments of multiplex PCR reactions. As seen in FIG. 3A, many samples were capable of producing approximately 1 million reads (e.g., $10^6$ reads). As illustrated, out of 78 samples, only 1 sample produced significantly fewer reads than other samples. Additionally, FIG. 3B illustrates partial failure of multiplex PCR reactions as a function of uniformity, in accordance with many embodiments using DBS as the sample source. In particular, FIG. 3B illustrates the percent of amplicons with at least 20% of the mean coverage of all amplicons. As illustrated in FIG. 3B, only 2 samples out of 78 showed limited uniformity among the amplicons. In combination, FIGS. 3A-3B illustrate that many embodiments are capable of amplifying upwards of 900 amplicons from a very low amount of input nucleic acids.

Generating Sequencing Libraries

Many sequencing library generation methods are known in the art, including commercially prepared kits for building such libraries, such as those from KAPA, Illumina, and other companies. However, many of these kits rely on ligating adapters to the ends of the target molecules rather than purely through PCR. Many embodiments will leverage the power of the homotags or homotags and spacer sequences to generate sequencing libraries for the target sequences.

Upon amplifying target sequences, a number of embodiments will generate sequencing libraries from the amplicons created during a PCR reaction, such as a PCR reaction described above. In certain embodiments, the sequencing libraries are created using a second PCR reaction. In a second reaction, additional primers can utilize the homotags to add additional adapters necessary for sequencing (e.g., Illumina P5 and/or P7 adapters). However, using the homotag sequences alone may not provide adequate representation of all amplicons in a reaction. For example, Illumina sequencing relies on different adapters residing at each end of a molecule to be sequenced. Using only the homotag sequences as primers would create an equal opportunity for the directional Illumina adapters to be added to each end, thus resulting in 50% of all molecules having the same sequencing adapter at each end of the molecule (P5-P5 or P7-P7). As such, many embodiments will utilize spacer sequences to create directionality for adding the sequencing adapters to the amplicons. As such, many adapters will have a structure as illustrated in FIGS. 4A-4B. In FIGS. 4A-4B, sequencing adapter primers 122, 124 utilize the homotag 114 and spacer sequences 118, 120 to amplify the amplicons. By using forward 118 and reverse 120 spacer sequences, attached at the 3'-end 108 of the sequencing adapter primers 122, 124, the system can allow for only one sequencing adapter 126, 128 is added to each end of a molecule. In general, sequencing specific primers 122, 124 can be described to have the structure 5'-D-A-C-3', where D is a sequencing adapter 126, 128, A is a homotag 114, 116, and C is a spacer sequence 118, 120. In many embodiments, the Illumina P5 adapter (SEQ ID NO: 2819) and Illumina P7 adapter (SEQ ID NO: 2820) will be used for the sequencing adapters 126, 128. In some embodiments, the forward sequencing adapter primer 122 will possess the structure 5'-Illumina P5 (SEQ ID NO: 2819)—homotag (SEQ ID NO: 2818)—forward spacer (TCTG)-3', and the reverse sequencing adapter primer 124 will possess the structure 5'-Illumina P7 (SEQ ID NO: 2820)—homotag (SEQ ID NO: 2818)—reverse spacer (AGAC)-3'.

Further embodiments of sequencing adapter primers will include index sequences to allow for multiplex sequencing of multiple samples simultaneously. Many methods are known in the art to index and/or multiplex samples for sequencing. In a number of embodiments, a Nextera-style indexing system is used. Nextera indexing is a system that integrates one or two indexes onto the molecules in a sequencing library. By using two indexes, a specific combination of indexes identifies a single sample. For example, a set of 8 indexes at a first location and a set of 12 indexes at a second location creates 96 unique combinations, thus allowing a total of 20 indexes to uniquely identify 96 individual samples, which can be used for embodiments that have performed PCR reactions on 96 individual samples. Many embodiments will utilize index sequences, as shown in Table 3:

TABLE 3

| List of Indexes | |
|---|---|
| First Indexes | Second Indexes |
| 5'-TAGATCGC-3' | 5'-TCGCCTTA-3' |
| 5'-CTCTCTAT-3' | 5'-CTAGTACG-3' |
| 5'-TATCCTCT-3' | 5'-TTCTGCCT-3' |

TABLE 3-continued

List of Indexes

| First Indexes | Second Indexes |
|---|---|
| 5'-AGAGTAGA-3' | 5'-GCTCAGGA-3' |
| 5'-GTAAGGAG-3' | 5'-AGGAGTCC-3' |
| 5'-ACTGCATA-3' | 5'-CATGCCTA-3' |
| 5'-AAGGAGTA-3' | 5'-GTAGAGAG-3' |
| 5'-CTAAGCCT-3' | 5'-CCTCTCTG-3' |
|  | 5'-AGCGTAGC-3' |
|  | 5'-CAGCCTCG-3' |
|  | 5'-TGCCTCTT-3' |
|  | 5'-TCCTCTAC-3' |

In many embodiments, the indexes shown in Table 3 are integrated between sequencing adapters and the homotags, such as illustrated in FIGS. 4C-4D. In FIGS. 4C-4D, sequencing adapter primers 122', 124' are illustrated. Specifically, FIG. 4C illustrates a first index 130 integrated between sequencing adapters 1 126 and homotag 114, while FIG. 4D illustrates a second index 132 integrated between sequencing adapter 2 128 and homotag 114. In general, sequencing specific primers 122', 124' can be described to have the structure 5'-D-E-A-C-3', where D is a sequencing adapter 126, 128, E is an index sequence 130, 132, A is a homotag 114, 116, and C is a spacer sequence 118, 120. As such, in some embodiments, the forward sequencing adapter primer 122' will possess the structure 5'-Illumina P5 (SEQ ID NO: 2819)—first index (Table 3)—homotag (SEQ ID NO: 2818)—forward spacer (TCTG), and the reverse sequencing adapter primer 124' will possess the structure 5'-Illumina P7 (SEQ ID NO: 2820)—second index (Table 3)—homotag (SEQ ID NO: 2818)—reverse spacer (AGAC)-3'.

However, many embodiments will utilize custom sequencing read primers based on the homotags 114, 116; in some of these embodiments customs sequencing read primers will incorporate homotags 114, 116 and spacers 118, 120. In such embodiments, additional base pairs may be necessary to raise the melting temperature of the sequencing read primers. FIG. 5A illustrates additional sequencing adapter primers 122", 124" that include modifying spacers 134, 136 between sequencing adapters 126, 128 and homotags 114, 116. Additionally, FIG. 5B illustrates sequencing adapter primers 122''', 124''' that include modifying spacers 134, 136 between indexes 130, 132 and homotags 114, 116. In general, the sequencing adapter primers 122", 124" can be described to have the structure 5'-D-F-A-C-3', while sequencing adapter primers 122''', 124''' can be described to have the structure 5'-D-E-F-A-C-3'. In these embodiments, D is a sequencing adapter 126, 128, E is an index sequence 130, 132, F is a modifying spacer 134, 136, A is a homotag 114, 116, and C is a spacer sequence 118, 120.

In many embodiments, the first modifying spacer 134 will be a dinucleotide GG increase the melting temperature of a first sequencing read primer. Additional embodiments will utilize the oligonucleotide CCGTTTA as the second modifying spacer 136 to increase the melting temperature of a second sequencing read primer. As such, some embodiments of the forward sequencing adapter 122" will possess the structure 5'-Illumina P5 (SEQ ID NO: 2819)—first modifying spacer (GG)-homotag (SEQ ID NO: 2818)—forward spacer (TCTG)-3', and the forward sequencing adapter primer 122''' will possess the structure 5'-Illumina P5 (SEQ ID NO: 2819)—first index(Table 3)-first modifying spacer (GG)-homotag (SEQ ID NO: 2818)—forward spacer (TCTG)-3'. Similarly, some embodiments of the reverse sequencing adapter primer 124" will possess the structure 5'-Illumina P7 (SEQ ID NO: 2820)—second modifying spacer (CCGTTTA)-homotag (SEQ ID NO: 2818)—reverse spacer (AGAC)-3', and reverse sequencing adapter primer 124''' will possess the structure 5'-Illumina P7 (SEQ ID NO: 2820)—second index (Table 3)—second modifying spacer (CCGTTTA)-homotag (SEQ ID NO: 2818)—reverse spacer (AGAC)-3'.

Many possible PCR cycling conditions can be used to create the sequencing libraries, based on the enzymes used, the melting temperature of the primers, and the length of the target molecules. In several embodiments the following cycling conditions are used:
  98° C. for 16 seconds,
  13 cycles of:
    98° C. for 16 seconds,
    72° C. for 20 seconds.

In a number of embodiments, the sequencing libraries are cleaned and/or purified after generation. In some embodiments, the cleaning uses commercially available kits, including kits using beads and/or columns. Some embodiments will use AMPure XP beads with a beat to sample ratio of 0.65:1, after which the sequencing libraries are eluted in 50 µL of water.

Further embodiments will size select the library to eliminate too long or too short fragments, which could be generated from primer dimers and/or off target amplification. Many kits exist to perform such size selection, which can be used in embodiments. Some embodiments will utilize a Pippin Prep system for size selection.

Additional embodiments will also quantify the library, which can be accomplished with many means, including UV-Vis spectroscopy, fluorescence, qPCR, and/or electrophoresis. Certain embodiments will perform library quantification using a Bioanalyzer.

Sequencing Targets

As noted above, many possible sequencing platforms can be utilized to sequence targets generated in many embodiments. Also, many embodiments will utilize an Illumina platform to sequence the targets, including an Illumina MiSeq. Sequencing can be performed in any capacity allowed by a particular piece of equipment, including single read, paired-end reads, and/or mate-pair reads. Many embodiments will utilize paired-end read capacity of the platform in order to obtain as much sequence as possible for a particular target, including the entirety of the target sequence.

With such a configuration as illustrated in FIGS. 6A-6C, custom sequencing read primers can utilize the homotags and spacer sequences as custom sequencing read primers. Specifically, FIG. 6A illustrates a first read sequencing primer 138; FIG. 6B illustrates a second read sequencing primer 140 in accordance with many embodiments; and FIG. 6C illustrates an indexing read primer 142, for embodiments including an index. In these embodiments, the sequencing read primers 138, 140 comprise a homotag 114, 116 located at the 5'-end of a spacer sequence 118, 120. In this configuration, the sequencing primers 138, 140 assure directionality of sequencing reads. In general, the sequencing read primers can be described to have the structure 5'-A-C-3', where A is a homotag 114, 116, and C is a spacer sequence 118, 120. In embodiments which include Nextera-style indexes, a separate indexing read is necessary to read a second index. In these embodiments, the indexing read primer 142 is typically a reverse complement of second read sequencing primer 140. This configuration is illustrated in FIG. 6C, which illustrates a reverse complement of reverse spacer 120' at the 5'-end of reverse complement of homotag 116'. Thus, in general, indexing read primer 142 can be described to have the structure 5'-C'-A'-3', where C' is the reverse complement of a reverse spacer 120', and A' is the reverse complement of a homotag 116'. In many embodiments, first sequencing read primer 138 will have the sequence of SEQ ID NO: 2821, which represents the structure 5'-homotag (SEQ ID NO: 2818)—forward spacer (TCTG)-3', and second sequencing read primer 140 will have the sequence of SEQ ID NO: 2822, which represents the structure 5'-homotag (SEQ ID NO: 2818)—reverse spacer (AGAC)-3'. Also, when an indexing read primer 142 is used, it will have the sequence of SEQ ID NO: 2823, which represents the reverse complement of 5'-homotag (SEQ ID NO: 2818)—reverse spacer (AGAC)-3'.

Figure 7B:
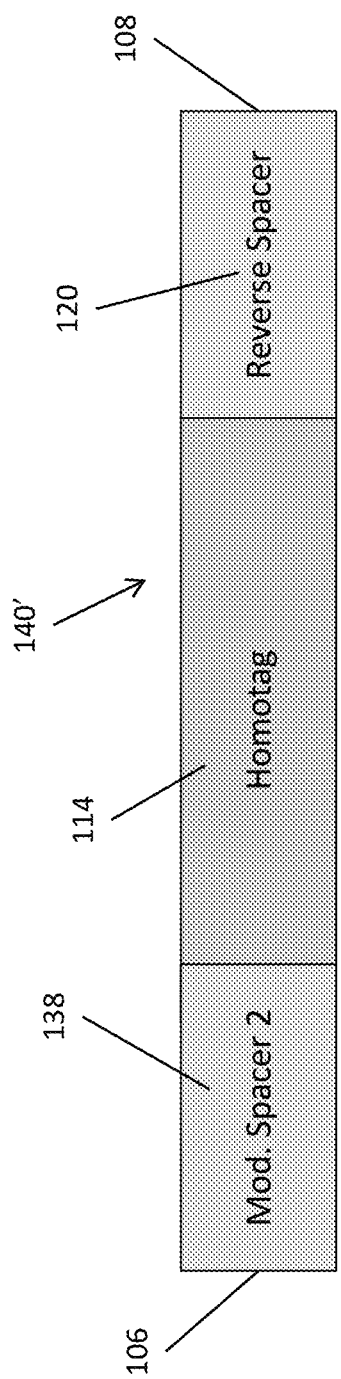
Figure 7C:
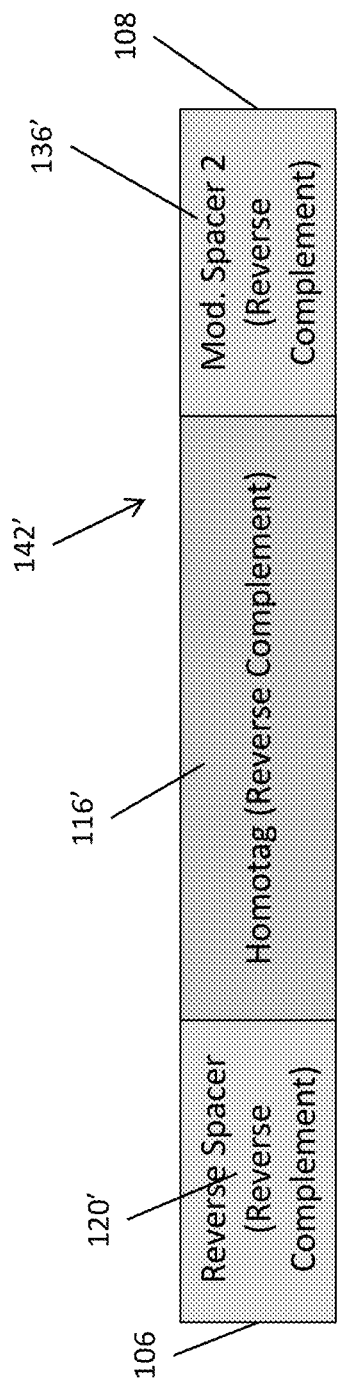

As noted above, some embodiments will include modifying spacers 136, 138 to increase the melting temperature of the sequencing primers. FIGS. 7A-7C illustrate embodiments which include modifying spacers 136, 138 to increase the melting temperature. In particular, FIGS. 7A-7B illustrate sequencing read primers 138', 140' comprising a modifying spacer 136, 138 located at the 5'-end of a homotag 114, 116, which is located at the 5'-end of a spacer sequence 118, 120. In this configuration, the sequencing primers 138, 140 assure directionality of sequencing reads and an increased melting temperature to comply with machine settings, uniformity, or any other relevant factor for ensuring proper sequencing reads. In general, the sequencing read primers can be described to have the structure 5'-F-A-C-3', where F is a modifying spacer 136, 138, A is a homotag 114, 116, and C is a spacer sequence 118, 120. In embodiments which include Nextera-style indexes, a separate indexing read is necessary to read a second index. In these embodiments, the indexing read primer 142' is typically a reverse complement of second read sequencing primer 140'. This configuration is illustrated in FIG. 7C, which illustrates a reverse complement of reverse spacer 120' at the 5'-end of reverse complement of homotag 116', which is located at the 5'-end of reverse complement of a second modifying spacer. Thus, in general, indexing read primer 142' can be described to have the structure 5'-C'-A'-F'-3', where C' is the reverse complement of a reverse spacer 120', A' is the reverse complement of a homotag 116', and F' is the reverse complement of a second modifying spacer 136'. In many embodiments, first sequencing read primer 138' will have the sequence of SEQ ID NO: 2824, which represents the structure 5'-first modifying spacer (GG)-homotag (SEQ ID NO: 2818)—forward spacer (TCTG)-3', and second sequencing read primer 140' will have the sequence of SEQ ID NO: 2825, which represents the structure 5'-second modifying spacer (CCGTTTA)-homotag (SEQ ID NO: 2818)—reverse spacer (AGAC)-3'. Also, when an indexing read primer 142' is used, it will have the sequence of SEQ ID NO: 2826, which represents the reverse complement of 5'-second modifying spacer (CCGTTTA)-homotag (SEQ ID NO: 2818)—reverse spacer (AGAC)-3'.

The raw data from a sequencer can be handled with innate software within the sequencing platform to generate the sequence files, including de-multiplexed sequence files (where multiple samples were multiplexed in the sequencing run). For example, MiSeq Control Software and MiSeq Reporter can analyze the raw image data and de-multiplexing of a run during and/or after a sequencing run has come to completion. Many embodiments will output the sequence in FASTA and/or FASTQ files for further analysis.

Figure 8A:
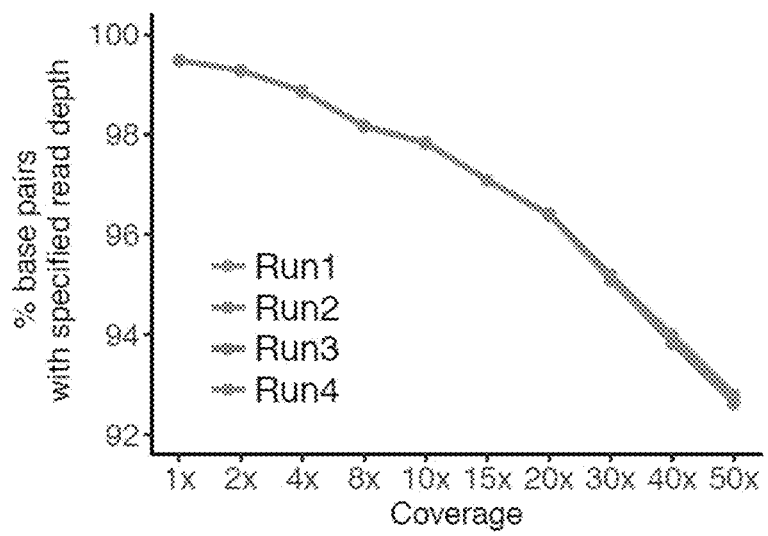
FIGS. 8A-8B illustrate results of sequencing reactions in accordance with embodiments.
Figure 8B:
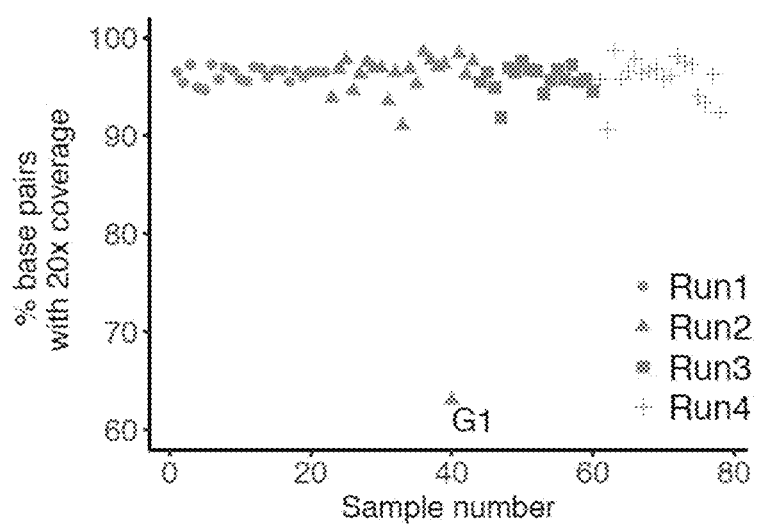

Turning to FIGS. 8A-8B, the success of sequencing libraries generated from embodiments are illustrated. In particular, FIG. 8A illustrates that embodiments produce consistent read depths across multiple sequencing runs. Additionally, FIG. 8B illustrates the success in sequencing individual samples, where the percent of base pairs with greater than 20× coverage are illustrated. As seen in FIG. 8B, most samples tested produced at least 20× coverage in greater than 90% of all bases sequenced, and only 1 sample (out of 78 samples) produced lower read depth.

Identify and Annotate Variants

Once sequences have been generated, as above, the target sequences can be analyzed to identify variants and/or possible genetic conditions associated with these variants. In many embodiments, the sequences for each sample are aligned to a reference genome to identify particular variants. Alignment can be performed using any known software package for performing such alignments, including BLAST, BLAT, BWA, among others. Once sequencing reads are aligned, certain embodiments will identify variants using known software packages, including GATK or similar software packages. Variants in accordance with many embodiments including single nucleotide variants (SNVs), copy number variants (CNVs), and insertion-deletion variants (indels). Once variants are identified, a number of embodiments will annotate the variants for nomenclature and/or disease associations using databases of such information, including HGVS, OMIM, dbSNP, ClinVar, and ExAC. An example of such output can be seen in Table 4. Table 4 illustrates results from an embodiment identifying a sample ID (e.g., specific coordinate on sample plate), underlying genetic condition, and numerous categories identifying genes with multiple pathologic (P) and/or likely pathologic (LP) variants, genes with variants of unknown significance (VUS), and PubMed identifiers for known variants identified. Many embodiments will automate this process by pipelining all analysis beginning from the sequence reads to an output of relevant annotations for an individual.

Figure 9A:
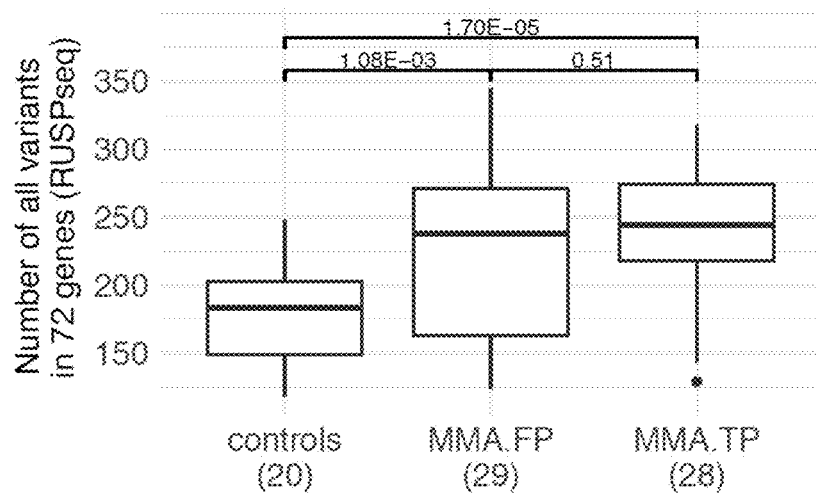
FIGS. 9A-9C illustrate sequence analysis results in accordance with embodiments.
Figure 9B:
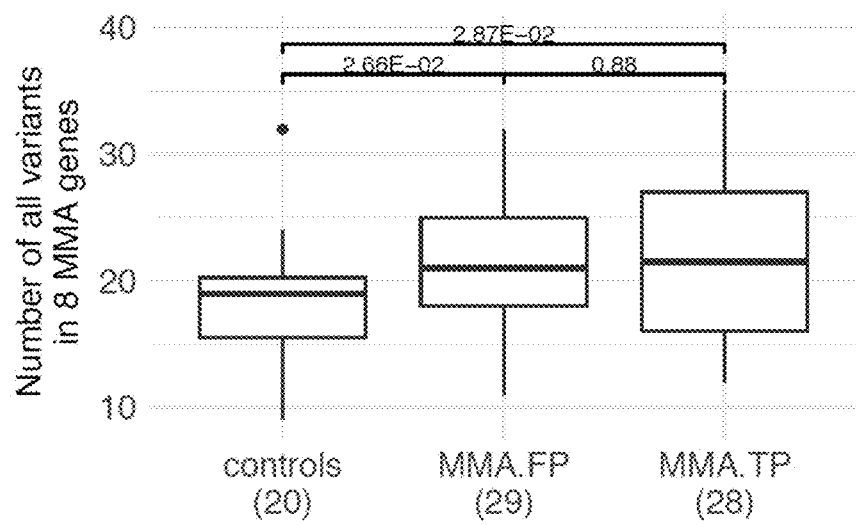
Figure 9C:
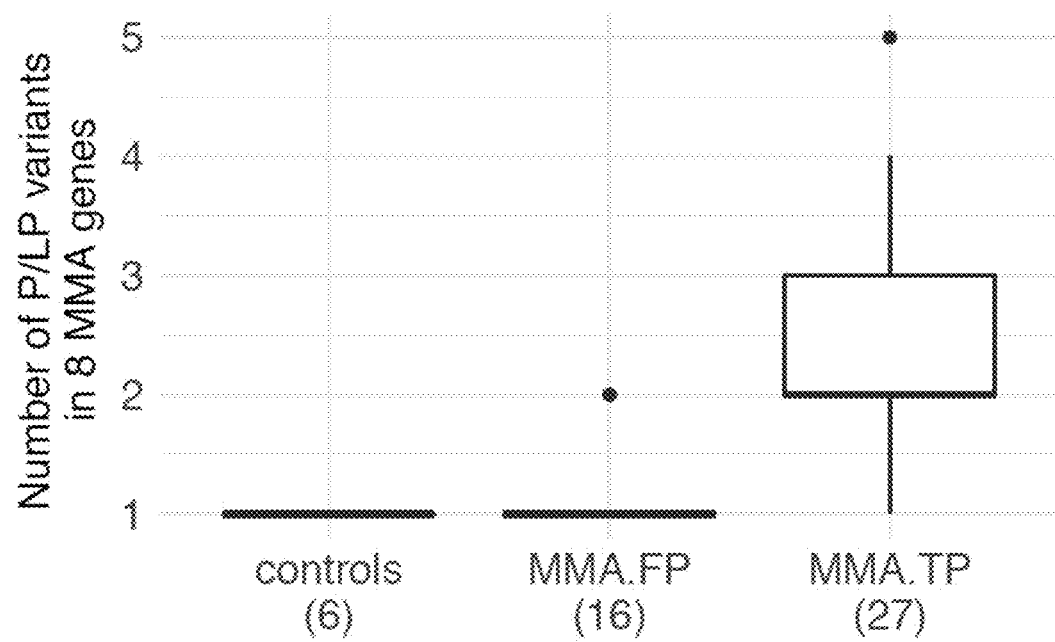

FIGS. 9A-9C summarize variants identified in many embodiments. In particular, FIG. 9A shows the distribution of the number of variants identified in control, false positive (MMA.FP) and true positive (MMA.TP) samples across 72 genes utilized in many embodiments. Similarly, FIG. 9B illustrates the number of variants distribution of the number of variants identified in control, false positive (as identified via MS/MS) (MMA.FP) and true positive (MMA.TP) samples across 8 MMA genes utilized in some embodiments. FIG. 9C illustrates the improvement in numerous embodiments, where pathogenic or likely pathogenic (P/LP) variants were identified in the true positive samples, thus reducing false positive rates, which reducing the demand for second-tier screening for many individuals, which in turn reduces the financial and/or emotional burden of receiving false positive results.

Treatment

In many embodiments, the results of sequencing and/or analysis, such as those described above will guide treatment of an individual. In certain embodiments, the results of the sequencing and/or analysis will be provided to a treating medical provider, such as a physician, nurse, or any other medical professional capable of providing treatment. Upon receiving such information as to metabolic conditions or other genetic diseases, the medical professional can utilize the information to select a treatment and provide the treatment to the individual. In many embodiments, the treatment step is an intervention, such as a drug, device, surgery, or other treatment designed to obviate symptoms and/or indications of the disease or condition, while additional embodiments will provide prophylaxis to the individual to prevent the onset of symptoms and/or complications that can arise due to the presence of a particular disease or condition identified from the sequencing and/or analysis.

EXEMPLARY EMBODIMENTS

Sequencing data supports the notion that embodiments described herein are capable of high plexity PCR amplification of target amplicons from very low nucleic acid inputs. The following data also details the ability to identify numerous metabolic conditions based on the presence of variants identified from target amplification. Accordingly, these data support the various embodiments of the invention as described.

Example 1: Amplifying and Sequencing Optimizing Sulfhydryl Blocking to Produce EVs Background: DBS samples contain small and varying amounts of blood, thus contain very limited amounts of nucleic acids, including DNA. As such, analysis of metabolic diseases, through biochemical or chemical techniques or through genetic analysis is difficult.

Methods: In one exemplary embodiment, multiplex PCR and sequencing were performed for 939 amplicons starting from 80 DBS samples.

Study specimens: Research was approved by the Institutional Review Boards at Yale University (Protocol ID: 1505015917), Stanford University (Protocol ID: 30618) and the State of California Committee for the Protection of Human Subjects (Protocol ID: 13-05-1236). De-identified residual DBS samples from 80 newborns from the California Biobank Program were used to validate the assay of this embodiment. These samples included 30 confirmed MMA cases, 30 MMA screen false-positives, and 20 DBS from healthy controls. In addition, metabolic data from a larger cohort of 803 newborns, consisting of 103 cases with confirmed MMA (24 mut0, 26 mut-, 45 Cbl C, D, or F, 3 Cbl A or B, and 5 unclassified MMA), 502 screen false-positives, and 198 healthy controls were evaluated. All newborns had routine MS/MS metabolic screening performed through the California NBS program between 2005 and 2015. The 56 MS/MS analytes included free carnitine, acylcarnitines, amino acids and calculated ratios. Additional data collected included newborn race/ethnicity, gestational age (GA, in days), birth weight (in grams), total parenteral nutrition (yes or no), and newborn age at blood collection (in hours).

DNA Extraction: A single 3 mm punch was taken from each DBS using a PE Wallac instrument (Perkin Elmer, Santa Clara) and deposited into a 96-well plate. Three blank paper spots were punched between each sample to prevent cross-contamination. DBS punch spots were washed twice with 180 µL of 10 mM NaOH. Each punch spot was then suspended in 50 µL of 10 mM NaOH solution and heated at 99° C. for 15 minutes in an Applied Biosystems GeneAmp PCR System 9700 (Life Technologies, Grand Island, NY). The supernatant, containing eluted DNA, was mixed by pipetting and then transferred to a clean tube containing 50 µL of 20 mM TrisCL pH 7.5. Two samples (D3, C11 in Table 4) of the 80 DBS failed in the DNA extraction.

Primer Design: A custom script integrating the primer design code from Primer 3 was used to generate target-specific forward and reverse primers for 939 amplicons for 362,013 base pairs (bp) of all exons and 20 bp of flanking intronic sequence of 72 genes based on hg19/GRCh37 (Table 2). Primer hybridization sites were selected to avoid common variants found in the National Center for Biotechnology Information (NCBI) single nucleotide polymorphism Database (dbSNP) build 137, June 2012 release. Primers were designed to have similar length (average 23 bp; range 21-27 bp), GC content, and amplicon size (average 412 bp, range 350-450 bp), matching the 2×250 bp paired-end sequencing chemistry on the MiSeq instrument (Illumina, San Diego, CA). Exons larger than 350 bp were covered by overlapping amplicons. Adapter sequences (e.g., homotag sequence SEQ ID NO: 2818) (24 bp) were included at the 5' end of each primer (e.g., SEQ ID NOs: 940-2817) for post-capture amplification.

Multiplex Target Capture: The 939 primer pairs (e.g., primers consisting SEQ ID NO: 2818 coupled to each of SEQ ID NOs: 940-2817) were pooled in one (1) tube for multiplex amplification 5 of 72 genes. Establishing a multiplex reaction in this embodiment required careful primer design and primer pool rebalancing, that included increasing or lowering the concentration of specific primers, replacing of failed primers, sequencing and data analysis. Primer optimization minimized amplicon dropout and non-specific amplification and achieved a 99% target base coverage from <10 ng of DBS DNA. Multiplex PCR was performed in a Veriti 96-well thermal cycler (Applied Biosystem, Foster City, CA) using 4-6 µL of extracted DNA in a 20 µL final volume and the KAPA2G Fast Multiplex PCR Kit (Kapa Biosystems, Wilmington, MA) across the following thermal profile: 95° C. for 3 minutes, 12 cycles of 95° C. for 16 seconds, 69-52° C. (−1.5° C. per cycle) for 2 minutes, and 72° C. for 45 seconds, followed by 10 cycles of 95° C. for 16 seconds, 72° C. for 20 seconds, and 72° C. for 2 minutes. PCR cleanup was performed by adding 14 µL (0.7:1) of AMPure XP beads (Beckman Coulter, Brea, CA) and clean up according to the manufacturer's manual, with a final elution in 14 µL elution buffer.

Sequence Library Construction: 78 samples in four MiSeq runs were sequenced by multiplexing 17 to 22 samples per run. A no-template water control was included in each run. Sequencing library preparation was performed according to the manufacturer's instructions (Illumina, San Diego, CA) using 5 µL of PCR product per sample. PCR was set up in 25 µL reactions, using common primers with sample specific indices and Illumina's P5 (SEQ ID NO: 2819) and P7 (SEQ ID NO: 2820) adapter sequences attached at the 5' end. Samples were barcoded with 8 bp dual indices (Table 3) according to Illumina's index sequencing protocol. KAPA2G Fast Multiplex PCR Kit (Kapa Biosystems, Wilmington, MA) was used to amplify DNA samples with the following cycling conditions: 98° C. for 16 seconds, 13 cycles of 98° C. for 16 seconds and 72° C. for 20 seconds. Following DNA quantification for each sample, samples were pooled (approximately 200-400 µL total volume) and purified using AMPure XP beads 5 (Beckman Coulter, Brea, CA) with a bead to sample ratio of 0.65:1 and eluted in 50 µL. 30 µL of the eluate was used for fragment size selection (440-720 bp) using the Pippin Prep system (Sage Science Inc., Beverly, MA), quantified the NGS library using Agilent Bioanalyzer (Agilent Technologies, Santa Clara, CA), and performed 2×250 bp PE sequencing on MiSeq (Illumina, San Diego, CA).

Sequence Data Analysis: Image analysis and sample de-multiplexing was performed with the Illumina MiSeq Control Software version 2.4.1 and MiSeq Reporter version 2.5.1.3 (Illumina, San Diego, CA). The resulting processed fastq files were aligned to the GRCh38 human reference genome using the Burrows-Wheeler Aligner (BWA-MEM, version 0.7.13-r1126). Picard (version 2.8.1) was used to sort and convert files to BAM format. Quality control (QC) metrics were extracted for each sample from the BAM file, including total number of reads, percent reads that were properly paired and mapped to the reference genome, read depths for each amplicon, and read depth for individual base pairs within the target region (FIGS. 3A-3B and FIGS. 8A-8B). DNA variant calling was performed using GATK (version 3.6-0-g8967209) with parameters as described previously. (See e.g., Lefterova M I, et al. Next-Generation Molecular Testing of Newborn Dried Blood Spots for Cystic Fibrosis. J Mol Diagn. 2016; 18(2):267-282; the disclosure of which is incorporated herein by reference in its entirety.) Annovar was used to annotate variants with the corresponding HGVS DNA and protein level nomenclature in combination with public information relevant for variant annotation from OMIM, dbSNP, ClinVar and ExAC. For each sample (Table 3), sequence variants were classified as pathologic (P), likely pathologic (LP), likely benign, benign, or of unknown significance (VUS) based on ACMG standards and guidelines for interpretation of sequence variants.

Results: This embodiment shows the development of a highly multiplex PCR and NGS method for the analysis of 939 amplicons derived from 72 genes for inborn metabolic disorders from DBS. Out of 80 starting samples, only 2 samples failed the DNA extraction protocol. FIG. 3A illustrates that only 1 of the remaining 78 samples failed in the multiplex PCR reaction, indicating the protocol is robust. Additionally, FIG. 3B illustrates that only 2 samples had partially failed amplification as indicated by 2 standard deviations below the mean depth coverage of all amplicons, one of these samples also failed the total multiplex PCR amplification. Additionally, FIG. 8A illustrates the robustness of embodiments, with consistent read depth across 4 sequencing runs on an Illumina MiSeq. Finally, FIG. 8B illustrates the per-base coverage in all samples. Again, only one sample had significantly lower depth coverage, which is the same sample that failed total and partial amplification. In the end, 77 out of 80 DBS samples were able to proceed to full sequence analysis with greater than 90% of all bases having at least 20× coverage, which provides high confidence for variant calling.

Table 4 summarizes many of the results for the 77 sequenced samples that were successfully sequenced. These 77 samples include 28 MMA patients, of which 25 patients were identified with two variants in an MMA gene, while two patients (B2 and F4) had only one P/LP variant and one patient (F3) had no variant in the eight MMA genes analyzed. In the 29 MMA false-positive cases, two samples (E10 and H10) were detected with two variants in an MMA gene, which in both samples were found in cis on the same amplicon reads and are thus located on the same chromosome. In the 20 control samples, two variants in an MMA gene were not detected. Analysis of the other 64 genes in this embodiment identified samples with two P/LP variants in PAH, PCCA, MTHFR, MLYCD, HPD, ACADVL, FAH, CPS1, DBT, and NAGS. In two 15 samples (B8 and H6) the two P/LP were found on the same chromosome in MLYCD and PAH, respectively.

Conclusion: The results illustrate the ability to amplify very high amounts of amplicons from an ultra-low amount of starting DNA. From the multiplex PCR reaction, sequencing libraries can be constructed to identify variants and underlying metabolic and/or genetic conditions for an individual based on the low levels of starting DNA. While 2 samples failed the DNA extraction protocol, only 1 sample failed the amplification and sequencing reactions, emphasizing the power and robustness of embodiments.

DOCTRINE OF EQUIVALENTS

While the above description contains many specific embodiments of the invention, these should not be construed as limitations on the scope of the invention, but rather as an example of one embodiment thereof. Accordingly, the scope of the invention should be determined not by the embodiments illustrated, but by the appended claims and their equivalents.

TABLE 1

Curation of 72 metabolic genes
Recommended Uniform Screening Panel (RUSP)*

| ACMG code | Conditions | Category | Condition type | Gene | NCBI Gene | NBS method | Primary analyte |
|---|---|---|---|---|---|---|---|
| PROP | Propionic Acidemia | core | Metab-OA | PCCA | 5095 | DBS, MS/MS | C3 |
| | | | | PCCB | 5096 | | |
| MUT | Methylmalonic Acidemia (mut-0, mut-) | core | Metab-OA | MUT | 4594 | DBS, MS/MS | C3 |
| Cbl-A, B | Methylmalonic Acidemia (Cobalamin disorders) | core | Metab-OA | MMAA | 166785 | DBS, MS/MS | C3 |
| | | | | MMAB | 326625 | | |
| IVA | Isovaleric Acidemia | core | Metab-OA | IVD | 3712 | DBS, MS/MS | C5 |
| 3-MCC | 3-Methylcrotonyl-CoA Carboxylase Deficiency | core | Metab-OA | MCCC1 | 56922 | DBS, MS/MS | C5-OH |
| | | | | MCCC2 | 64087 | | |
| HMG | 3-Hydroxy-3-Methylglutaric Aciduria | core | Metab-OA | HMGCL | 3155 | DBS, MS/MS | C5-OH |
| MCD | Holocarboxylase Synthase deficiency | core | Metab-OA | HLCS | 3141 | DBS, MS/MS | C5-OH |
| | | | | BTD | 686 | | |
| BKT | Beta-Ketothiolase Deficiency | core | Metab-OA | ACAT1 | 38 | DBS, MS/MS | C5-OH |
| GA1 | Glutaric Acidemia Type I | core | Metab-OA | GCDH | 2639 | DBS, MS/MS | C5-DC |
| CUD | Carnitine Uptake Defect/Carnitine Transport Defect | core | Metab-FAO | SLC22A5 | 6584 | DBS, MS/MS | C0 |

TABLE 1-continued

Curation of 72 metabolic genes
Recommended Uniform Screening Panel (RUSP)*

| ACMG code | Conditions | Category | Condition type | Gene | NCBI Gene | NBS method | Primary analyte |
|---|---|---|---|---|---|---|---|
| MCAD | Medium-chain Acyl-CoA Dehydrogenase Deficiency | core | Metab-FAO | ACADM | 34 | DBS, MS/MS | C8 |
| VLCAD | Very Long-chain Acyl-CoA Dehydrogenase Deficiency | core | Metab-FAO | ACADVL | 37 | DBS, MS/MS | C14:1 |
| LCHAD | Long-chain L-3 Hydroxyacyl-CoA Dehydrogenase Deficiency | core | Metab-FAO | HADHA HADHB | 3030 3032 | DBS, MS/MS | C16-OH |
| TFP | Trifunctional Protein Deficiency | core | Metab-FAO | HADHA HADHB | 3030 3032 | DBS, MS/MS | C16-OH |
| ASA | Argininosuccinic Aciduria | core | Metab-AA | ASL | 435 | DBS, MS/MS | Citrulline |
| CIT | Citrullinemia, Type I | core | Metab-AA | ASS1 | 445 | DBS, MS/MS | Citrulline |
| MSUD | Maple Syrup Urine Disease | core | Metab-AA | BCKDHA BCKDHB DBT DLD BCKDK PPM1K | 593 594 1629 1738 10295 152926 | DBS, MS/MS | Leucine, Isoleucine |
| HCY | Homocystinuria | core | Metab-AA | CBS MTHFR MTR MTRR | 875 4524 4548 4552 | DBS, MS/MS | Methionine |
| PKU | Classical Phenylketonuria | core | Metab-AA | PAH | 5053 | DBS, MS/MS | Phenylalanine |
| TYR-I | Tyrosinemia, Type I | core | Metab-AA | FAH | 2184 | DBS, MS/MS | Tyrosine, Succinylacetone |
| BIOT | Biotinidase Deficiency | core | Metab-other | BTD | 686 | DBS, enzyme | Biotinidase |
| CF | Cystic Fibrosis | core | Other-disorder | CFTR | 1080 | DBS, IRT | IRT |
| GALT | Classical Galactosemia | core | Metab-other | GALT | 2592 | DBS, enzyme | Galactose, GALT activity |
| Cbl-C, D | Methylmalonic acidemia with homocystinuria | secondary | Metab-OA | MMACHC MMADHC | 25974 27249 | DBS, MS/MS | C3 |
| MAL | Malonic acidemia | secondary | Metab-OA | MLYCD | 23417 | DBS, MS/MS | C3-DC |
| IBG/IBD | Isobutyrylglycinuria | secondary | Metab-OA | ACAD8 | 27034 | DBS, MS/MS | C4 |
| 2MBG | 2-Methylbutyrylglycinuria | secondary | Metab-OA | ACADSB | 36 | DBS, MS/MS | C5 |
| 3MGA | 3-Methylglutaconic aciduria | secondary | Metab-OA | AUH OPA3 TAZ | 549 80207 131118 | DBS, MS/MS | C5OH |
| 2M3HBA | 2-Methyl-3-hydroxybutyric aciduria | secondary | Metab-OA | HSD17B10 | 3028 | DBS, MS/MS | C5OH |
| SCAD | Short-chain acyl-CoA dehydrogenase deficiency | secondary | Metab-FAO | ACADS | 35 | DBS, MS/MS | C4 |
| M/SCHAD | Medium/short-chain L-3-hydroxyacyl-CoA dehydrogenase deficiency | secondary | Metab-FAO | HADH | 3033 | DBS, MS/MS | C4OH |
| GA-II | Glutaric acidemia type II | secondary | Metab-FOA | ETFA ETFB ETFDH | 2108 2109 2110 | DBS, MS/MS | C4 |
| MCAT | Medium-chain ketoacyl-CoA thiolase deficiency | secondary | Metab-FAO | HADHA HADHB | 3030 3032 | DBS, MS/MS | C16OH |
| CPT-IA | Carnitine palmitoyltransferase type I deficiency | secondary | Metab-FAO | CPT1A | 1374 | DBS, MS/MS | CO/C16 + 18 |
| CPT-II | Carnitine palmitoyltransferase type II deficiency | secondary | Metab-FAO | CPT2 | 1376 | DBS, MS/MS | C16 |
| CACT | Carnitine acylcarnitine translocase deficiency | secondary | Metab-FAO | SLC25A20 | 788 | DBS, MS/MS | C16 |
| ARG | Argininemia | secondary | Metab-AA | ARG1 | 383 | DBS, MS/MS | Arginine |
| CIT-II | Citrullinemia, type II | secondary | Metab-AA | SLC25A13 | 10165 | DBS, MS/MS | Citrulline |
| MET | Hypermethioninemia | secondary | Metab-AA | MAT1A AHCY GNMT | 4143 191 27232 | DBS, MS/MS | Methionine |
| H-PHE | Benign hyperphenylaninemia | secondary | Metab-AA | PAH | 5053 | DBS, MS/MS | Phenylalanine |
| BIOPT(BS) | Biopterin defect in cofactor biosynthesis | secondary | Metab-AA | GCH1 PTS | 2643 5805 | DBS, MS/MS | Phenylalanine |
| BIOPT(REG) | Biopterin defect in cofactor regeneration | secondary | Metab-AA | QDPR PCBD1 | 5860 5092 | DBS, MS/MS | Phenylalanine |
| TYR-II | Tyrosinemia, type II | secondary | Metab-AA | TAT | 6898 | DBS, MS/MS | Tyrosine |

TABLE 1-continued

Curation of 72 metabolic genes
Recommended Uniform Screening Panel (RUSP)*

| ACMG code | Conditions | Category | Condition type | Gene | NCBI Gene | NBS method | Primary analyte |
|---|---|---|---|---|---|---|---|
| TYR-III | Tyrosinemia, type III | secondary | Metab-AA | HPD | 3242 | DBS, MS/MS | Tyrosine |
| GALE | Galactoepimerase deficiency | secondary | Other-disorder | GALE | 2582 | DBS, galactose | Galactose |
| GALK | Galactokinase deficiency | secondary | Other-disorder | GALK1 | 2584 | DBS, galactose | Galactose |

Additional RUSPseq conditions (Not on the RUSP)*

| ACMG code | Conditions | Category | Condition type | Gene | NCBI Gene | NBS method | Primary analyte |
|---|---|---|---|---|---|---|---|
| (OTC) | Ornithine transcarbamylase deficiency | — | Metab-AA | OTC | 5009 | DBS, MS/MS | Citrulline. Screened in CA since 2010. |
| (CPS) | Carbamoyl-phosphate synthetase deficiency | — | Metab-AA | CPS1 | 1373 | — | No NBS. Included due to Hyperammonemia. |
| (NAGSD) | N-acetylglutamate synthase deficiency | — | Metab-AA | NAGS | 162417 | — | No NBS. Included due to Hyperammonemia. |
| (Cbl-F) | Methylmalonic aciduria and homocystinuria, Cbl-F type | — | Metab-OA | LMBRD1 | 55788 | DBS, MS/MS | Related to Cbl-A, B and Cbl-C, D. |
| (CMAMMA) | Combined malonic and methylmalonic aciduria | — | Metab-OA | ACSF3 | 197322 | DBS, MS/MS | No NBS. Included due to MMA. |
| (MCEE) | Methylmalonyl-CoA epimerase deficiency | — | Metab-OA | MCEE | 84693 | DBS, MS/MS | No NBS. Included due to MMA. |
| (NKH) | Nonketotic hyperglycemia | — | Metab-AA | AMT GLDC | 275 2731 | — — | No NBS. Included due to DLD (PDH complex). |

*Reference: www.hrsa.gov/advisory-committees/heritable-disorders/rusp/index.html

TABLE 2

Target and Primer SEQ ID NOs

| Target Name | Target Sequence SEQ ID No | Forward Primer SEQ ID No | Reverse Primer SEQ ID No |
|---|---|---|---|
| ACAD8_exon_1-utr5_1 | 1 | 940 | 1879 |
| ACAD8_exon_2-utr5_1 | 2 | 941 | 1880 |
| ACAD8_exon_4-utr3_4d | 3 | 942 | 1881 |
| ACAD8_exon_5-utr3_6a | 4 | 943 | 1882 |
| ACAD8_exon_5-utr3_6b | 5 | 944 | 1883 |
| ACAD8_exon_5-utr3_6c | 6 | 945 | 1884 |
| ACAD8_exon_5-utr3_6f | 7 | 946 | 1885 |
| ACAD8_exon_6-utr3_1 | 8 | 947 | 1886 |
| ACAD8_exon_7-utr3_1 | 9 | 948 | 1887 |
| ACAD8_exon_8-utr3_19a | 10 | 949 | 1888 |
| ACAD8_exon_8-utr3_19d | 11 | 950 | 1889 |
| ACAD8_exon_8-utr3_19e | 12 | 951 | 1890 |
| ACAD8_exon_8-utr3_19i | 13 | 952 | 1891 |
| ACAD8_exon_9-utr3_3a | 14 | 953 | 1892 |
| ACADM_exon_10-utr3_2a | 15 | 954 | 1893 |
| ACADM_exon_10-utr3_2b | 16 | 955 | 1894 |
| ACADM_exon_11-utr3_3a | 17 | 956 | 1895 |
| ACADM_exon_1-utr5_2b | 18 | 957 | 1896 |
| ACADM_exon_2_1 | 19 | 958 | 1897 |
| ACADM_exon_3_1 | 20 | 959 | 1898 |
| ACADM_exon_4-utr5_3a | 21 | 960 | 1899 |
| ACADM_exon_4-utr5_3b | 22 | 961 | 1900 |
| ACADM_exon_4-utr5_3c | 23 | 962 | 1901 |
| ACADM_exon_5-utr3_1 | 24 | 963 | 1902 |
| ACADM_exon_6-utr5_1 | 25 | 964 | 1903 |
| ACADM_exon_7-utr3_2a | 26 | 965 | 1904 |
| ACADM_exon_7-utr3_3c | 27 | 966 | 1905 |
| ACADM_exon_8-utr3_1 | 28 | 967 | 1906 |
| ACADS_exon_10-utr3_2a | 29 | 968 | 1907 |
| ACADS_exon_1-utr5_1 | 30 | 969 | 1908 |
| ACADS_exon_2_1 | 31 | 970 | 1909 |
| ACADS_exon_3_3a | 32 | 971 | 1910 |
| ACADS_exon_3_3b | 33 | 972 | 1911 |
| ACADS_exon_3_3c | 34 | 973 | 1912 |
| ACADS_exon_4_1 | 35 | 974 | 1913 |
| ACADS_exon_5_1 | 36 | 975 | 1914 |
| ACADS_exon_6_1 | 37 | 976 | 1915 |
| ACADS_exon_7_1 | 38 | 977 | 1916 |
| ACADS_exon_8_1 | 39 | 978 | 1917 |
| ACADS_exon_9_1 | 40 | 979 | 1918 |
| ACADSB_exon_10_1 | 41 | 980 | 1919 |
| ACADSB_exon_11_2a | 42 | 981 | 1920 |
| ACADSB_exon_11_2b | 43 | 982 | 1921 |
| ACADSB_exon_12-utr3_37ab | 44 | 983 | 1922 |
| ACADSB_exon_1-utr5_1 | 45 | 984 | 1923 |
| ACADSB_exon_2_1 | 46 | 985 | 1924 |
| ACADSB_exon_3-utr5_1 | 47 | 986 | 1925 |
| ACADSB_exon_4_1 | 48 | 987 | 1926 |
| ACADSB_exon_5-utr5_1 | 49 | 988 | 1927 |
| ACADSB_exon_6_1 | 50 | 989 | 1928 |
| ACADSB_exon_7_1 | 51 | 990 | 1929 |
| ACADSB_exon_8_1 | 52 | 991 | 1930 |
| ACADSB_exon_9_1 | 53 | 992 | 1931 |
| ACADVL_exon_1-utr5_1 | 54 | 993 | 1932 |
| ACADVL_exon_2_1 | 55 | 994 | 1933 |
| ACADVL_exon_3-utr5_4a | 56 | 995 | 1934 |
| ACADVL_exon_3-utr5_4b | 57 | 996 | 1935 |
| ACADVL_exon_3-utr5_4c | 58 | 997 | 1936 |
| ACADVL_exon_3-utr5_4d | 59 | 998 | 1937 |
| ACADVL_exon_4-utr3_2b | 60 | 999 | 1938 |
| ACADVL_exon_5-utr3_2a | 61 | 1000 | 1939 |
| ACADVL_exon_5-utr3_2b | 62 | 1001 | 1940 |
| ACADVL_exon_6-utr3_2a | 63 | 1002 | 1941 |
| ACADVL_exon_6-utr3_2b | 64 | 1003 | 1942 |
| ACADVL_exon_7-utr3_5a | 65 | 1004 | 1943 |
| ACADVL_exon_7-utr3_5b | 66 | 1005 | 1944 |
| ACADVL_exon_7-utr3_5c | 67 | 1006 | 1945 |
| ACADVL_exon_7-utr3_5d | 68 | 1007 | 1946 |
| ACAT1_exon_10-utr3_15a | 69 | 1008 | 1947 |
| ACAT1_exon_10-utr3_15b | 70 | 1009 | 1948 |

TABLE 2-continued

Target and Primer SEQ ID NOs

| Target Name | Target Sequence SEQ ID No | Forward Primer SEQ ID No | Reverse Primer SEQ ID No |
|---|---|---|---|
| ACAT1_exon_10-utr3_5e | 71 | 1010 | 1949 |
| ACAT1_exon_11_1 | 72 | 1011 | 1950 |
| ACAT1_exon_12_1 | 73 | 1012 | 1951 |
| ACAT1_exon_13-utr3_2a | 74 | 1013 | 1952 |
| ACAT1_exon_1-utr5_1 | 75 | 1014 | 1953 |
| ACAT1_exon_2-utr5_1 | 76 | 1015 | 1954 |
| ACAT1_exon_3-utr5_1 | 77 | 1016 | 1955 |
| ACAT1_exon_4-utr5_1 | 78 | 1017 | 1956 |
| ACAT1_exon_5_1 | 79 | 1018 | 1957 |
| ACAT1_exon_6-utr3_3a | 80 | 1019 | 1958 |
| ACAT1_exon_7-utr3_5d | 81 | 1020 | 1959 |
| ACAT1_exon_8-utr3_1 | 82 | 1021 | 1960 |
| ACAT1_exon_9-utr3_1 | 83 | 1022 | 1961 |
| ACAT1_utr5_1 | 84 | 1023 | 1962 |
| ACSF3_exon_10-utr3_21j | 85 | 1024 | 1963 |
| ACSF3_exon_10-utr3_61ay | 86 | 1025 | 1964 |
| ACSF3_exon_10-utr3_61bv | 87 | 1026 | 1965 |
| ACSF3_exon_10-utr3_61bx | 88 | 1027 | 1966 |
| ACSF3_exon_1-utr5_2a | 89 | 1028 | 1967 |
| ACSF3_exon_1-utr5_2b | 90 | 1029 | 1968 |
| ACSF3_exon_2-utr5_1 | 91 | 1030 | 1969 |
| ACSF3_exon_3_1 | 92 | 1031 | 1970 |
| ACSF3_exon_4_1 | 93 | 1032 | 1971 |
| ACSF3_exon_5_1 | 94 | 1033 | 1972 |
| ACSF3_exon_6-utr3_2a | 95 | 1034 | 1973 |
| ACSF3_exon_7-utr3_1 | 96 | 1035 | 1974 |
| ACSF3_exon_8_1 | 97 | 1036 | 1975 |
| ACSF3_exon_9-utr3_1 | 98 | 1037 | 1976 |
| ACSF3_utr5_5_1 | 99 | 1038 | 1977 |
| AHCY_exon_1-utr5_1 | 100 | 1039 | 1978 |
| AHCY_exon_2-utr5_1 | 101 | 1040 | 1979 |
| AHCY_exon_3_2a | 102 | 1041 | 1980 |
| AHCY_exon_4_1 | 103 | 1042 | 1981 |
| AHCY_exon_5_1 | 104 | 1043 | 1982 |
| AHCY_exon_6_1 | 105 | 1044 | 1983 |
| AHCY_exon_7_1 | 106 | 1045 | 1984 |
| AHCY_exon_8_1 | 107 | 1046 | 1985 |
| AHCY_exon_9-utr3_3a | 108 | 1047 | 1986 |
| AMT_exon_1-utr5_4a | 109 | 1048 | 1987 |
| AMT_exon_1-utr5_4b | 110 | 1049 | 1988 |
| AMT_exon_1-utr5_4c | 111 | 1050 | 1989 |
| AMT_exon_1-utr5_4d | 112 | 1051 | 1990 |
| AMT_exon_2-utr3_6c | 113 | 1052 | 1991 |
| AMT_exon_2-utr3_6d | 114 | 1053 | 1992 |
| AMT_exon_2-utr3_6e | 115 | 1054 | 1993 |
| AMT_exon_2-utr3_6f | 116 | 1055 | 1994 |
| AMT_exon_3-utr3_1 | 117 | 1056 | 1995 |
| AMT_exon_4-utr3_3a | 118 | 1057 | 1996 |
| AMT_exon_4-utr3_3b | 119 | 1058 | 1997 |
| ARG1_exon_1-utr5_1 | 120 | 1059 | 1998 |
| ARG1_exon_2_1 | 121 | 1060 | 1999 |
| ARG1_exon_3_2a | 122 | 1061 | 2000 |
| ARG1_exon_4_1 | 123 | 1062 | 2001 |
| ARG1_exon_5_1 | 124 | 1063 | 2002 |
| ARG1_exon_6_1 | 125 | 1064 | 2003 |
| ARG1_exon_7_1 | 126 | 1065 | 2004 |
| ARG1_exon_8-utr3_2a | 127 | 1066 | 2005 |
| ASL_exon_1_1 | 128 | 1067 | 2006 |
| ASL_exon_10_1 | 129 | 1068 | 2007 |
| ASL_exon_11_1 | 130 | 1069 | 2008 |
| ASL_exon_12_1 | 131 | 1070 | 2009 |
| ASL_exon_13-utr3_8b | 132 | 1071 | 2010 |
| ASL_exon_3_2a | 133 | 1072 | 2011 |
| ASL_exon_3_2b | 134 | 1073 | 2012 |
| ASL_exon_4_1 | 135 | 1074 | 2013 |
| ASL_exon_6_1 | 136 | 1075 | 2014 |
| ASL_exon_7_1 | 137 | 1076 | 2015 |
| ASL_exon_8_1 | 138 | 1077 | 2016 |
| ASL_exon_9_1 | 139 | 1078 | 2017 |
| ASL_processed_transcript_1 | 140 | 1079 | 2018 |
| ASL_utr5_1 | 141 | 1080 | 2019 |
| ASS1_exon_10_1 | 142 | 1081 | 2020 |
| ASS1_exon_11_1 | 143 | 1082 | 2021 |
| ASS1_exon_12_1 | 144 | 1083 | 2022 |
| ASS1_exon_13_1 | 145 | 1084 | 2023 |
| ASS1_exon_14-utr3_1 | 146 | 1085 | 2024 |
| ASS1_exon_1-utr5_1 | 147 | 1086 | 2025 |
| ASS1_exon_2_1 | 148 | 1087 | 2026 |
| ASS1_exon_3_1 | 149 | 1088 | 2027 |
| ASS1_exon_4_1 | 150 | 1089 | 2028 |
| ASS1_exon_5_1 | 151 | 1090 | 2029 |
| ASS1_exon_6_1 | 152 | 1091 | 2030 |
| ASS1_exon_7_1 | 153 | 1092 | 2031 |
| ASS1_exon_8_2b | 154 | 1093 | 2032 |
| ASS1_exon_9_1 | 155 | 1094 | 2033 |
| AUH_exon_10_1 | 156 | 1095 | 2034 |
| AUH_exon_11-utr3_2a | 157 | 1096 | 2035 |
| AUH_exon_1-utr5_1 | 158 | 1097 | 2036 |
| AUH_exon_3_1 | 159 | 1098 | 2037 |
| AUH_exon_4_1 | 160 | 1099 | 2038 |
| AUH_exon_5_1 | 161 | 1100 | 2039 |
| AUH_exon_6_1 | 162 | 1101 | 2040 |
| AUH_exon_8_1 | 163 | 1102 | 2041 |
| AUH_exon_9_1 | 164 | 1103 | 2042 |
| BCKDHA_exon_1_1 | 165 | 1104 | 2043 |
| BCKDHA_exon_10-utr3_2a | 166 | 1105 | 2044 |
| BCKDHA_exon_10-utr3_2b | 167 | 1106 | 2045 |
| BCKDHA_exon_2-utr5_2b | 168 | 1107 | 2046 |
| BCKDHA_exon_3_1 | 169 | 1108 | 2047 |
| BCKDHA_exon_4_1 | 170 | 1109 | 2048 |
| BCKDHA_exon_5_1 | 171 | 1110 | 2049 |
| BCKDHA_exon_6_1 | 172 | 1111 | 2050 |
| BCKDHA_exon_7_1 | 173 | 1112 | 2051 |
| BCKDHA_exon_8_1 | 174 | 1113 | 2052 |
| BCKDHA_exon_9_1 | 175 | 1114 | 2053 |
| BCKDHB_exon_10-utr3_1 | 176 | 1115 | 2054 |
| BCKDHB_exon_11-utr3_8a | 177 | 1116 | 2055 |
| BCKDHB_exon_1-utr5_1 | 178 | 1117 | 2056 |
| BCKDHB_exon_3_1 | 179 | 1118 | 2057 |
| BCKDHB_exon_4_1 | 180 | 1119 | 2058 |
| BCKDHB_exon_5_1 | 181 | 1120 | 2059 |
| BCKDHB_exon_6-utr3_1 | 182 | 1121 | 2060 |
| BCKDHB_exon_7-utr3_1 | 183 | 1122 | 2061 |
| BCKDHB_exon_8-utr3_1 | 184 | 1123 | 2062 |
| BCKDHB_exon_9-utr3_1 | 185 | 1124 | 2063 |
| BCKDHB_processed_transcript_1_1 | 186 | 1125 | 2064 |
| BCKDK_exon_1-utr5_2b | 187 | 1126 | 2065 |
| BCKDK_exon_2_1 | 188 | 1127 | 2066 |
| BCKDK_exon_3_2b | 189 | 1128 | 2067 |
| BCKDK_exon_4_1 | 190 | 1129 | 2068 |
| BCKDK_exon_5_3a | 191 | 1130 | 2069 |
| BCKDK_exon_5_3b | 192 | 1131 | 2070 |
| BCKDK_exon_5_3c | 193 | 1132 | 2071 |
| BCKDK_exon_6-utr3_1 | 194 | 1133 | 2072 |
| BCKDK_exon_7-utr3_3a | 195 | 1134 | 2073 |
| BCKDK_exon_7-utr3_3b | 196 | 1135 | 2074 |
| BCKDK_exon_7-utr3_3c | 197 | 1136 | 2075 |
| BTD_exon_1-utr5_2b | 198 | 1137 | 2076 |
| BTD_exon_2-utr5_1 | 199 | 1138 | 2077 |
| BTD_exon_3-utr5_1 | 200 | 1139 | 2078 |
| BTD_exon_4_1 | 201 | 1140 | 2079 |
| BTD_exon_5-utr3_4a | 202 | 1141 | 2080 |
| BTD_exon_5-utr3_4b | 203 | 1142 | 2081 |
| BTD_exon_5-utr3_4c | 204 | 1143 | 2082 |
| BTD_exon_5-utr3_4d | 205 | 1144 | 2083 |
| CBS_exon_10_2b | 206 | 1145 | 2084 |
| CBS_exon_11_1 | 207 | 1146 | 2085 |
| CBS_exon_12_1 | 208 | 1147 | 2086 |
| CBS_exon_13_1 | 209 | 1148 | 2087 |
| CBS_exon_14-utr3_3a | 210 | 1149 | 2088 |
| CBS_exon_14-utr3_3b | 211 | 1150 | 2089 |
| CBS_exon_15-utr3_2a | 212 | 1151 | 2090 |
| CBS_exon_1-utr5_1 | 213 | 1152 | 2091 |
| CBS_exon_2_1 | 214 | 1153 | 2092 |
| CBS_exon_3_1 | 215 | 1154 | 2093 |
| CBS_exon_4_1 | 216 | 1155 | 2094 |

TABLE 2-continued

Target and Primer SEQ ID NOs

| Target Name | Target Sequence SEQ ID No | Forward Primer SEQ ID No | Reverse Primer SEQ ID No |
|---|---|---|---|
| CBS_exon_5_1 | 217 | 1156 | 2095 |
| CBS_exon_6_1 | 218 | 1157 | 2096 |
| CBS_exon_7_1 | 219 | 1158 | 2097 |
| CBS_exon_8_2a | 220 | 1159 | 2098 |
| CBS_exon_9_1 | 221 | 1160 | 2099 |
| CBS_processed_transcript-retained_intron | 222 | 1161 | 2100 |
| CFTR_exon_1 | 223 | 1162 | 2101 |
| CFTR_exon_10 | 224 | 1163 | 2102 |
| CFTR_exon_11n | 225 | 1164 | 2103 |
| CFTR_exon_12n | 226 | 1165 | 2104 |
| CFTR_exon_13 | 227 | 1166 | 2105 |
| CFTR_exon_14_3a | 228 | 1167 | 2106 |
| CFTR_exon_14_3b | 229 | 1168 | 2107 |
| CFTR_exon_14_3c | 230 | 1169 | 2108 |
| CFTR_exon_15 | 231 | 1170 | 2109 |
| CFTR_exon_16 | 232 | 1171 | 2110 |
| CFTR_exon_17 | 233 | 1172 | 2111 |
| CFTR_exon_18n | 234 | 1173 | 2112 |
| CFTR_exon_19n | 235 | 1174 | 2113 |
| CFTR_exon_20_2a1 | 236 | 1175 | 2114 |
| CFTR_exon_20_2b1 | 237 | 1176 | 2115 |
| CFTR_exon_21 | 238 | 1177 | 2116 |
| CFTR_exon_22_2a | 239 | 1178 | 2117 |
| CFTR_exon_22_2b | 240 | 1179 | 2118 |
| CFTR_exon_23 | 241 | 1180 | 2119 |
| CFTR_exon_24 | 242 | 1181 | 2120 |
| CFTR_exon_25 | 243 | 1182 | 2121 |
| CFTR_exon_26 | 244 | 1183 | 2122 |
| CFTR_exon_27_6a | 245 | 1184 | 2123 |
| CFTR_exon_27_6b | 246 | 1185 | 2124 |
| CFTR_exon_27_6c | 247 | 1186 | 2125 |
| CFTR_exon_27_6d1 | 248 | 1187 | 2126 |
| CFTR_exon_27_6e1 | 249 | 1188 | 2127 |
| CFTR_exon_27_6f | 250 | 1189 | 2128 |
| CFTR_exon_2n1 | 251 | 1190 | 2129 |
| CFTR_exon_3 | 252 | 1191 | 2130 |
| CFTR_exon_4 | 253 | 1192 | 2131 |
| CFTR_exon_5 | 254 | 1193 | 2132 |
| CFTR_exon_6n | 255 | 1194 | 2133 |
| CFTR_exon_7 | 256 | 1195 | 2134 |
| CFTR_exon_8 | 257 | 1196 | 2135 |
| CFTR_exon_9 | 258 | 1197 | 2136 |
| CFTR_intron_12 | 259 | 1198 | 2137 |
| CFTR_intron_target_27b | 260 | 1199 | 2138 |
| CFTR_processed_transcript_3 | 261 | 1200 | 2139 |
| CFTR_promotor | 262 | 1201 | 2140 |
| CFTR_rs139688774 | 263 | 1202 | 2141 |
| CFTR_utr5_1 | 264 | 1203 | 2142 |
| CFTR_utr5_2 | 265 | 1204 | 2143 |
| CPS1_exon_10_1 | 266 | 1205 | 2144 |
| CPS1_exon_11_1 | 267 | 1206 | 2145 |
| CPS1_exon_12-utr5_1 | 268 | 1207 | 2146 |
| CPS1_exon_13-utr5_1 | 269 | 1208 | 2147 |
| CPS1_exon_14_1 | 270 | 1209 | 2148 |
| CPS1_exon_15_1 | 271 | 1210 | 2149 |
| CPS1_exon_16_1 | 272 | 1211 | 2150 |
| CPS1_exon_17_1 | 273 | 1212 | 2151 |
| CPS1_exon_18_1 | 274 | 1213 | 2152 |
| CPS1_exon_19_1 | 275 | 1214 | 2153 |
| CPS1_exon_1-utr5_1 | 276 | 1215 | 2154 |
| CPS1_exon_2_1 | 277 | 1216 | 2155 |
| CPS1_exon_20_1 | 278 | 1217 | 2156 |
| CPS1_exon_21_1 | 279 | 1218 | 2157 |
| CPS1_exon_22_1 | 280 | 1219 | 2158 |
| CPS1_exon_23_1 | 281 | 1220 | 2159 |
| CPS1_exon_24_1 | 282 | 1221 | 2160 |
| CPS1_exon_25_1 | 283 | 1222 | 2161 |
| CPS1_exon_26_1 | 284 | 1223 | 2162 |
| CPS1_exon_27_1 | 285 | 1224 | 2163 |
| CPS1_exon_28_1 | 286 | 1225 | 2164 |
| CPS1_exon_29_1 | 287 | 1226 | 2165 |
| CPS1_exon_3_1 | 288 | 1227 | 2166 |
| CPS1_exon_30_1 | 289 | 1228 | 2167 |
| CPS1_exon_31_1 | 290 | 1229 | 2168 |
| CPS1_exon_32_1 | 291 | 1230 | 2169 |
| CPS1_exon_33_1 | 292 | 1231 | 2170 |
| CPS1_exon_34_1 | 293 | 1232 | 2171 |
| CPS1_exon_35_16p | 294 | 1233 | 2172 |
| CPS1_exon_36_1 | 295 | 1234 | 2173 |
| CPS1_exon_37_1 | 296 | 1235 | 2174 |
| CPS1_exon_38-utr3_4a | 297 | 1236 | 2175 |
| CPS1_exon_4_1 | 298 | 1237 | 2176 |
| CPS1_exon_5_1 | 299 | 1238 | 2177 |
| CPS1_exon_6_1 | 300 | 1239 | 2178 |
| CPS1_exon_7_1 | 301 | 1240 | 2179 |
| CPS1_exon_8_1 | 302 | 1241 | 2180 |
| CPS1_exon_9_1 | 303 | 1242 | 2181 |
| CPS1_utr5_1_1 | 304 | 1243 | 2182 |
| CPT1A_exon_10_1 | 305 | 1244 | 2183 |
| CPT1A_exon_11_1 | 306 | 1245 | 2184 |
| CPT1A_exon_12_1 | 307 | 1246 | 2185 |
| CPT1A_exon_13_1 | 308 | 1247 | 2186 |
| CPT1A_exon_14_1 | 309 | 1248 | 2187 |
| CPT1A_exon_15_1 | 310 | 1249 | 2188 |
| CPT1A_exon_16_1 | 311 | 1250 | 2189 |
| CPT1A_exon_17_1 | 312 | 1251 | 2190 |
| CPT1A_exon_19-utr3_8a | 313 | 1252 | 2191 |
| CPT1A_exon_1-utr5_1 | 314 | 1253 | 2192 |
| CPT1A_exon_2_1 | 315 | 1254 | 2193 |
| CPT1A_exon_20-utr3_1 | 316 | 1255 | 2194 |
| CPT1A_exon_3_1 | 317 | 1256 | 2195 |
| CPT1A_exon_4_1 | 318 | 1257 | 2196 |
| CPT1A_exon_5-utr5_1 | 319 | 1258 | 2197 |
| CPT1A_exon_6-utr5_1 | 320 | 1259 | 2198 |
| CPT1A_exon_8_1 | 321 | 1260 | 2199 |
| CPT1A_exon_9-utr3_1 | 322 | 1261 | 2200 |
| CPT2_exon_1-utr5_2b | 323 | 1262 | 2201 |
| CPT2_exon_2_1 | 324 | 1263 | 2202 |
| CPT2_exon_3_2a | 325 | 1264 | 2203 |
| CPT2_exon_4_4a | 326 | 1265 | 2204 |
| CPT2_exon_4_4b | 327 | 1266 | 2205 |
| CPT2_exon_4_4c | 328 | 1267 | 2206 |
| CPT2_exon_4_4d | 329 | 1268 | 2207 |
| CPT2_exon_5-utr3_3a | 330 | 1269 | 2208 |
| DBT_exon_10_1 | 331 | 1270 | 2209 |
| DBT_exon_11-utr3_1 | 332 | 1271 | 2210 |
| DBT_exon_11-utr3_71ac | 333 | 1272 | 2211 |
| DBT_exon_1-utr5_1 | 334 | 1273 | 2212 |
| DBT_exon_2_1 | 335 | 1274 | 2213 |
| DBT_exon_3_1 | 336 | 1275 | 2214 |
| DBT_exon_4_1 | 337 | 1276 | 2215 |
| DBT_exon_5_1 | 338 | 1277 | 2216 |
| DBT_exon_6_1 | 339 | 1278 | 2217 |
| DBT_exon_7_1 | 340 | 1279 | 2218 |
| DBT_exon_8-utr3_2a | 341 | 1280 | 2219 |
| DBT_exon_8-utr3_2b | 342 | 1281 | 2220 |
| DBT_exon_9_1 | 343 | 1282 | 2221 |
| DLD_exon_10-utr3_1 | 344 | 1283 | 2222 |
| DLD_exon_11-utr3_1 | 345 | 1284 | 2223 |
| DLD_exon_12-utr3_1 | 346 | 1285 | 2224 |
| DLD_exon_13-utr3_19b | 347 | 1286 | 2225 |
| DLD_exon_1-utr5_1 | 348 | 1287 | 2226 |
| DLD_exon_2-utr5_1 | 349 | 1288 | 2227 |
| DLD_exon_3_1 | 350 | 1289 | 2228 |
| DLD_exon_4_1 | 351 | 1290 | 2229 |
| DLD_exon_5-utr5_1 | 352 | 1291 | 2230 |
| DLD_exon_6-utr3_2a | 353 | 1292 | 2231 |
| DLD_exon_6-utr3_2b | 354 | 1293 | 2232 |
| DLD_exon_7-utr3_1 | 355 | 1294 | 2233 |
| DLD_exon_8-utr3_1 | 356 | 1295 | 2234 |
| DLD_exon_9-utr3_1 | 357 | 1296 | 2235 |
| DLD_processed_transcript_1 | 358 | 1297 | 2236 |
| DLD_utr3_1_2b | 359 | 1298 | 2237 |
| ETFA_exon_10-utr3_1 | 360 | 1299 | 2238 |
| ETFA_exon_11-utr3_3a | 361 | 1300 | 2239 |
| ETFA_exon_12-utr3_5e | 362 | 1301 | 2240 |

TABLE 2-continued

Target and Primer SEQ ID NOs

| Target Name | Target Sequence SEQ ID No | Forward Primer SEQ ID No | Reverse Primer SEQ ID No |
|---|---|---|---|
| ETFA_exon_13-utr3_1 | 363 | 1302 | 2241 |
| ETFA_exon_14-utr3_4a | 364 | 1303 | 2242 |
| ETFA_exon_1-utr5_1 | 365 | 1304 | 2243 |
| ETFA_exon_2-utr3_1 | 366 | 1305 | 2244 |
| ETFA_exon_3-utr5_1 | 367 | 1306 | 2245 |
| ETFA_exon_4-utr5_1 | 368 | 1307 | 2246 |
| ETFA_exon_5-utr5_1 | 369 | 1308 | 2247 |
| ETFA_exon_6-utr5_1 | 370 | 1309 | 2248 |
| ETFA_exon_9-utr5_1 | 371 | 1310 | 2249 |
| ETFB_exon_1-utr5_1 | 372 | 1311 | 2250 |
| ETFB_exon_2-utr5_8g | 373 | 1312 | 2251 |
| ETFB_exon_2-utr5_8h | 374 | 1313 | 2252 |
| ETFB_exon_3_1 | 375 | 1314 | 2253 |
| ETFB_exon_5_8e | 376 | 1315 | 2254 |
| ETFB_exon_6-utr3_1 | 377 | 1316 | 2255 |
| ETFDH_exon_10_1 | 378 | 1317 | 2256 |
| ETFDH_exon_11_1 | 379 | 1318 | 2257 |
| ETFDH_exon_12_1 | 380 | 1319 | 2258 |
| ETFDH_exon_13-utr3_4a | 381 | 1320 | 2259 |
| ETFDH_exon_1-utr5_1 | 382 | 1321 | 2260 |
| ETFDH_exon_2_1 | 383 | 1322 | 2261 |
| ETFDH_exon_3_2a | 384 | 1323 | 2262 |
| ETFDH_exon_3_5e | 385 | 1324 | 2263 |
| ETFDH_exon_4-utr5_1 | 386 | 1325 | 2264 |
| ETFDH_exon_5-utr5_1 | 387 | 1326 | 2265 |
| ETFDH_exon_6_1 | 388 | 1327 | 2266 |
| ETFDH_exon_7_1 | 389 | 1328 | 2267 |
| ETFDH_exon_8_1 | 390 | 1329 | 2268 |
| ETFDH_exon_9_1 | 391 | 1330 | 2269 |
| FAH_exon_10_1 | 392 | 1331 | 2270 |
| FAH_exon_11-utr3_1 | 393 | 1332 | 2271 |
| FAH_exon_12-utr3_1 | 394 | 1333 | 2272 |
| FAH_exon_13-utr3_3a | 395 | 1334 | 2273 |
| FAH_exon_1-utr5_6f | 396 | 1335 | 2274 |
| FAH_exon_2-utr5_1 | 397 | 1336 | 2275 |
| FAH_exon_3_1 | 398 | 1337 | 2276 |
| FAH_exon_4_4a | 399 | 1338 | 2277 |
| FAH_exon_5_1 | 400 | 1339 | 2278 |
| FAH_exon_6_1 | 401 | 1340 | 2279 |
| FAH_exon_7_1 | 402 | 1341 | 2280 |
| FAH_exon_8_2a | 403 | 1342 | 2281 |
| FAH_exon_9_1 | 404 | 1343 | 2282 |
| FAH_processed_transcript_1 | 405 | 1344 | 2283 |
| FAH_utr5_2_1 | 406 | 1345 | 2284 |
| GALE_exon_1_3a | 407 | 1346 | 2285 |
| GALE_exon_1_3b | 408 | 1347 | 2286 |
| GALE_exon_1_3c | 409 | 1348 | 2287 |
| GALE_exon_2_1 | 410 | 1349 | 2288 |
| GALE_exon_4_1 | 411 | 1350 | 2289 |
| GALE_exon_5-utr3_4a | 412 | 1351 | 2290 |
| GALE_exon_5-utr3_4b | 413 | 1352 | 2291 |
| GALE_exon_5-utr3_4c | 414 | 1353 | 2292 |
| GALE_exon_5-utr3_4d | 415 | 1354 | 2293 |
| GALK1_exon_1-utr-5_2b | 416 | 1355 | 2294 |
| GALK1_exon_2-utr3_4a | 417 | 1356 | 2295 |
| GALK1_exon_2-utr3_4b | 418 | 1357 | 2296 |
| GALK1_exon_2-utr3_4c | 419 | 1358 | 2297 |
| GALK1_exon_2-utr3_4d | 420 | 1359 | 2298 |
| GALK1_exon_3-utr3_2a | 421 | 1360 | 2299 |
| GALK1_exon_3-utr3_2b | 422 | 1361 | 2300 |
| GALK1_exon_4-utr3_1 | 423 | 1362 | 2301 |
| GALT_exon_1-utr3_4a | 424 | 1363 | 2302 |
| GALT_exon_1-utr3_4b | 425 | 1364 | 2303 |
| GALT_exon_1-utr3_4c | 426 | 1365 | 2304 |
| GALT_exon_1-utr3_4d | 427 | 1366 | 2305 |
| GALT_exon_2-utr3_5a | 428 | 1367 | 2306 |
| GALT_exon_2-utr3_5b | 429 | 1368 | 2307 |
| GALT_exon_2-utr3_5c | 430 | 1369 | 2308 |
| GALT_exon_2-utr3_5d | 431 | 1370 | 2309 |
| GALT_exon_3-utr3_2a | 432 | 1371 | 2310 |
| GCDH_exon_10-utr3_1 | 433 | 1372 | 2311 |
| GCDH_exon_11-utr3_2a | 434 | 1373 | 2312 |
| GCDH_exon_12-utr3_1 | 435 | 1374 | 2313 |
| GCDH_exon_1-utr5_1 | 436 | 1375 | 2314 |
| GCDH_exon_2-utr3_2a | 437 | 1376 | 2315 |
| GCDH_exon_3-utr3_4a | 438 | 1377 | 2316 |
| GCDH_exon_5_2a | 439 | 1378 | 2317 |
| GCDH_exon_6-utr3_1 | 440 | 1379 | 2318 |
| GCDH_exon_7-utr3_1 | 441 | 1380 | 2319 |
| GCDH_exon_8-utr3_1 | 442 | 1381 | 2320 |
| GCDH_exon_9-utr3_2a | 443 | 1382 | 2321 |
| GCDH_exon_9-utr3_2b | 444 | 1383 | 2322 |
| GCH1_exon_1-utr5_2a | 445 | 1384 | 2323 |
| GCH1_exon_1-utr5_2b | 446 | 1385 | 2324 |
| GCH1_exon_2_1 | 447 | 1386 | 2325 |
| GCH1_exon_3_1 | 448 | 1387 | 2326 |
| GCH1_exon_4_1 | 449 | 1388 | 2327 |
| GCH1_exon_5_1 | 450 | 1389 | 2328 |
| GCH1_exon_6-utr3_6a | 451 | 1390 | 2329 |
| GCH1_exon_6-utr3_6b | 452 | 1391 | 2330 |
| GCH1_exon_6-utr3_6c | 453 | 1392 | 2331 |
| GCH1_exon_6-utr3_6d | 454 | 1393 | 2332 |
| GLDC_exon_10_1 | 455 | 1394 | 2333 |
| GLDC_exon_11_1 | 456 | 1395 | 2334 |
| GLDC_exon_12_1 | 457 | 1396 | 2335 |
| GLDC_exon_13_1 | 458 | 1397 | 2336 |
| GLDC_exon_14_1 | 459 | 1398 | 2337 |
| GLDC_exon_15_1 | 460 | 1399 | 2338 |
| GLDC_exon_16_1 | 461 | 1400 | 2339 |
| GLDC_exon_17_2a | 462 | 1401 | 2340 |
| GLDC_exon_18_1 | 463 | 1402 | 2341 |
| GLDC_exon_19_1 | 464 | 1403 | 2342 |
| GLDC_exon_1-utr5_2a | 465 | 1404 | 2343 |
| GLDC_exon_1-utr5_2b | 466 | 1405 | 2344 |
| GLDC_exon_2_1 | 467 | 1406 | 2345 |
| GLDC_exon_20_1 | 468 | 1407 | 2346 |
| GLDC_exon_21_1 | 469 | 1408 | 2347 |
| GLDC_exon_22_1 | 470 | 1409 | 2348 |
| GLDC_exon_23_1 | 471 | 1410 | 2349 |
| GLDC_exon_24_1 | 472 | 1411 | 2350 |
| GLDC_exon_25-utr3_2a | 473 | 1412 | 2351 |
| GLDC_exon_3_1 | 474 | 1413 | 2352 |
| GLDC_exon_4_1 | 475 | 1414 | 2353 |
| GLDC_exon_5_1 | 476 | 1415 | 2354 |
| GLDC_exon_6_1 | 477 | 1416 | 2355 |
| GLDC_exon_7_1 | 478 | 1417 | 2356 |
| GLDC_exon_8_1 | 479 | 1418 | 2357 |
| GLDC_exon_9_1 | 480 | 1419 | 2358 |
| GNMT_exon_1-utr5_1 | 481 | 1420 | 2359 |
| GNMT_exon_2_1 | 482 | 1421 | 2360 |
| GNMT_exon_3_1 | 483 | 1422 | 2361 |
| GNMT_exon_4_1 | 484 | 1423 | 2362 |
| GNMT_exon_5_1 | 485 | 1424 | 2363 |
| GNMT_exon_6-utr3_1 | 486 | 1425 | 2364 |
| HADH_exon_10-utr3_3a | 487 | 1426 | 2365 |
| HADH_exon_1-utr5_1 | 488 | 1427 | 2366 |
| HADH_exon_2-utr5_1 | 489 | 1428 | 2367 |
| HADH_exon_3_1 | 490 | 1429 | 2368 |
| HADH_exon_4_1 | 491 | 1430 | 2369 |
| HADH_exon_5_1 | 492 | 1431 | 2370 |
| HADH_exon_6_1 | 493 | 1432 | 2371 |
| HADH_exon_7_2a | 494 | 1433 | 2372 |
| HADH_exon_8_1 | 495 | 1434 | 2373 |
| HADHA_exon_10-utr3_2a | 496 | 1435 | 2374 |
| HADHA_exon_11_1 | 497 | 1436 | 2375 |
| HADHA_exon_12_1 | 498 | 1437 | 2376 |
| HADHA_exon_13_1 | 499 | 1438 | 2377 |
| HADHA_exon_14_1 | 500 | 1439 | 2378 |
| HADHA_exon_15_1 | 501 | 1440 | 2379 |
| HADHA_exon_16_1 | 502 | 1441 | 2380 |
| HADHA_exon_17_1 | 503 | 1442 | 2381 |
| HADHA_exon_18_1 | 504 | 1443 | 2382 |
| HADHA_exon_19-utr3_3a | 505 | 1444 | 2383 |
| HADHA_exon_19-utr3_3b | 506 | 1445 | 2384 |
| HADHA_exon_1-utr5_1 | 507 | 1446 | 2385 |
| HADHA_exon_2-utr5_1 | 508 | 1447 | 2386 |

TABLE 2-continued

Target and Primer SEQ ID NOs

| Target Name | Target Sequence SEQ ID No | Forward Primer SEQ ID No | Reverse Primer SEQ ID No |
|---|---|---|---|
| HADHA_exon_4_1 | 509 | 1448 | 2387 |
| HADHA_exon_5_1 | 510 | 1449 | 2388 |
| HADHA_exon_6_1 | 511 | 1450 | 2389 |
| HADHA_exon_7_1 | 512 | 1451 | 2390 |
| HADHA_exon_8_1 | 513 | 1452 | 2391 |
| HADHA_exon_9_1 | 514 | 1453 | 2392 |
| HADHB_exon_10_1 | 515 | 1454 | 2393 |
| HADHB_exon_12_1 | 516 | 1455 | 2394 |
| HADHB_exon_13_1 | 517 | 1456 | 2395 |
| HADHB_exon_14_1 | 518 | 1457 | 2396 |
| HADHB_exon_15_1 | 519 | 1458 | 2397 |
| HADHB_exon_16-utr3_2a | 520 | 1459 | 2398 |
| HADHB_exon_1-utr5_1 | 521 | 1460 | 2399 |
| HADHB_exon_2-utr5_2a | 522 | 1461 | 2400 |
| HADHB_exon_3-utr5_3b | 523 | 1462 | 2401 |
| HADHB_exon_4_1 | 524 | 1463 | 2402 |
| HADHB_exon_5_1 | 525 | 1464 | 2403 |
| HADHB_exon_6_1 | 526 | 1465 | 2404 |
| HADHB_exon_7_1 | 527 | 1466 | 2405 |
| HADHB_exon_8_1 | 528 | 1467 | 2406 |
| HADHB_exon_9_1 | 529 | 1468 | 2407 |
| HLCS_exon_2_3a | 530 | 1469 | 2408 |
| HLCS_exon_2_3b | 531 | 1470 | 2409 |
| HLCS_exon_2_3c | 532 | 1471 | 2410 |
| HLCS_exon_3_1 | 533 | 1472 | 2411 |
| HLCS_exon_4_2a | 534 | 1473 | 2412 |
| HLCS_exon_5_1 | 535 | 1474 | 2413 |
| HLCS_exon_6_1 | 536 | 1475 | 2414 |
| HLCS_exon_7_1 | 537 | 1476 | 2415 |
| HLCS_exon_8_1 | 538 | 1477 | 2416 |
| HLCS_exon_9-utr3_9a | 539 | 1478 | 2417 |
| HMGCL_exon_1-utr5_1 | 540 | 1479 | 2418 |
| HMGCL_exon_2-utr3_1 | 541 | 1480 | 2419 |
| HMGCL_exon_3-utr3_1 | 542 | 1481 | 2420 |
| HMGCL_exon_4-utr3_2a | 543 | 1482 | 2421 |
| HMGCL_exon_5-utr3_2a | 544 | 1483 | 2422 |
| HMGCL_exon_6-utr3_4a | 545 | 1484 | 2423 |
| HMGCL_exon_7-utr3_1 | 546 | 1485 | 2424 |
| HMGCL_exon_9-utr3_2a | 547 | 1486 | 2425 |
| HPD_exon_10_1 | 548 | 1487 | 2426 |
| HPD_exon_11_1 | 549 | 1488 | 2427 |
| HPD_exon_12_1 | 550 | 1489 | 2428 |
| HPD_exon_13-utr3_1 | 551 | 1490 | 2429 |
| HPD_exon_2-utr5_1 | 552 | 1491 | 2430 |
| HPD_exon_3-utr5_2a | 553 | 1492 | 2431 |
| HPD_exon_3-utr5_2b | 554 | 1493 | 2432 |
| HPD_exon_4_1 | 555 | 1494 | 2433 |
| HPD_exon_5_1 | 556 | 1495 | 2434 |
| HPD_exon_6_1 | 557 | 1496 | 2435 |
| HPD_exon_7_1 | 558 | 1497 | 2436 |
| HPD_exon_8_1 | 559 | 1498 | 2437 |
| HPD_exon_9_1 | 560 | 1499 | 2438 |
| HPD_utr5_2_1 | 561 | 1500 | 2439 |
| HSD17B10_exon_1-utr5_1 | 562 | 1501 | 2440 |
| HSD17B10_exon_2_1 | 563 | 1502 | 2441 |
| HSD17B10_exon_3_1 | 564 | 1503 | 2442 |
| HSD17B10_exon_4_1 | 565 | 1504 | 2443 |
| HSD17B10_exon_5_1 | 566 | 1505 | 2444 |
| HSD17B10_exon_6-utr3_1 | 567 | 1506 | 2445 |
| IVD_exon_10-utr3_1 | 568 | 1507 | 2446 |
| IVD_exon_11-utr3_1 | 569 | 1508 | 2447 |
| IVD_exon_12-utr3_1 | 570 | 1509 | 2448 |
| IVD_exon_13-utr3_30aa | 571 | 1510 | 2449 |
| IVD_exon_13-utr3_9c | 572 | 1511 | 2450 |
| IVD_exon_14-utr3_1 | 573 | 1512 | 2451 |
| IVD_exon_15_1 | 574 | 1513 | 2452 |
| IVD_exon_16-utr3_2a | 575 | 1514 | 2453 |
| IVD_exon_1-utr5_2b | 576 | 1515 | 2454 |
| IVD_exon_2-utr5_1 | 577 | 1516 | 2455 |
| IVD_exon_3_1 | 578 | 1517 | 2456 |
| IVD_exon_4_1 | 579 | 1518 | 2457 |
| IVD_exon_5_1 | 580 | 1519 | 2458 |
| IVD_exon_6_1 | 581 | 1520 | 2459 |
| IVD_exon_7_1 | 582 | 1521 | 2460 |
| IVD_exon_8_1 | 583 | 1522 | 2461 |
| IVD_exon_9_2b | 584 | 1523 | 2462 |
| LMBRD1_exon_10_1 | 585 | 1524 | 2463 |
| LMBRD1_exon_11_1 | 586 | 1525 | 2464 |
| LMBRD1_exon_12_1 | 587 | 1526 | 2465 |
| LMBRD1_exon_13-utr3_1 | 588 | 1527 | 2466 |
| LMBRD1_exon_14-utr3_1 | 589 | 1528 | 2467 |
| LMBRD1_exon_15-utr3_1 | 590 | 1529 | 2468 |
| LMBRD1_exon_16-utr3_2a | 591 | 1530 | 2469 |
| LMBRD1_exon_1-utr5_1 | 592 | 1531 | 2470 |
| LMBRD1_exon_2-utr5_2a | 593 | 1532 | 2471 |
| LMBRD1_exon_2-utr5_2b | 594 | 1533 | 2472 |
| LMBRD1_exon_3_1 | 595 | 1534 | 2473 |
| LMBRD1_exon_4_1 | 596 | 1535 | 2474 |
| LMBRD1_exon_5_1 | 597 | 1536 | 2475 |
| LMBRD1_exon_6_1 | 598 | 1537 | 2476 |
| LMBRD1_exon_7_1 | 599 | 1538 | 2477 |
| LMBRD1_exon_8_1 | 600 | 1539 | 2478 |
| LMBRD1_exon_9_1 | 601 | 1540 | 2479 |
| MAT1A_exon_1-utr5_1 | 602 | 1541 | 2480 |
| MAT1A_exon_2_1 | 603 | 1542 | 2481 |
| MAT1A_exon_3_1 | 604 | 1543 | 2482 |
| MAT1A_exon_4_1 | 605 | 1544 | 2483 |
| MAT1A_exon_5_1 | 606 | 1545 | 2484 |
| MAT1A_exon_6_1 | 607 | 1546 | 2485 |
| MAT1A_exon_7_a | 608 | 1547 | 2486 |
| MAT1A_exon_7_b | 609 | 1548 | 2487 |
| MAT1A_exon_8_1 | 610 | 1549 | 2488 |
| MAT1A_exon_9-utr3_6a | 611 | 1550 | 2489 |
| MCCC1_exon_11-utr3_1 | 612 | 1551 | 2490 |
| MCCC1_exon_12-utr3_1 | 613 | 1552 | 2491 |
| MCCC1_exon_13-utr3_1 | 614 | 1553 | 2492 |
| MCCC1_exon_14-utr3_1 | 615 | 1554 | 2493 |
| MCCC1_exon_15-utr3_1 | 616 | 1555 | 2494 |
| MCCC1_exon_16-utr3_1 | 617 | 1556 | 2495 |
| MCCC1_exon_17-utr3_1 | 618 | 1557 | 2496 |
| MCCC1_exon_18-utr3_1 | 619 | 1558 | 2497 |
| MCCC1_exon_19-utr3_1 | 620 | 1559 | 2498 |
| MCCC1_exon_1-utr5_1 | 621 | 1560 | 2499 |
| MCCC1_exon_2-utr5_1 | 622 | 1561 | 2500 |
| MCCC1_exon_3_1 | 623 | 1562 | 2501 |
| MCCC1_exon_4-utr3_1 | 624 | 1563 | 2502 |
| MCCC1_exon_5-utr5_1 | 625 | 1564 | 2503 |
| MCCC1_exon_6-utr3_1 | 626 | 1565 | 2504 |
| MCCC1_exon_7-utr3_1 | 627 | 1566 | 2505 |
| MCCC1_exon_8-utr3_1 | 628 | 1567 | 2506 |
| MCCC1_exon_9-utr3_1 | 629 | 1568 | 2507 |
| MCCC2_exon_10_10a | 630 | 1569 | 2508 |
| MCCC2_exon_10_10f | 631 | 1570 | 2509 |
| MCCC2_exon_10_10h | 632 | 1571 | 2510 |
| MCCC2_exon_11-utr3_1 | 633 | 1572 | 2511 |
| MCCC2_exon_12-utr3_1 | 634 | 1573 | 2512 |
| MCCC2_exon_14-utr3_1 | 635 | 1574 | 2513 |
| MCCC2_exon_15-utr3_1 | 636 | 1575 | 2514 |
| MCCC2_exon_16-utr3_1 | 637 | 1576 | 2515 |
| MCCC2_exon_17-utr3_5a | 638 | 1577 | 2516 |
| MCCC2_exon_1-utr5_1 | 639 | 1578 | 2517 |
| MCCC2_exon_2_1 | 640 | 1579 | 2518 |
| MCCC2_exon_3_1 | 641 | 1580 | 2519 |
| MCCC2_exon_4_1 | 642 | 1581 | 2520 |
| MCCC2_exon_5_2a | 643 | 1582 | 2521 |
| MCCC2_exon_6_1 | 644 | 1583 | 2522 |
| MCCC2_exon_7_1 | 645 | 1584 | 2523 |
| MCCC2_exon_8_1 | 646 | 1585 | 2524 |
| MCCC2_exon_9_1 | 647 | 1586 | 2525 |
| MCEE_exon_1-utr5_2a | 648 | 1587 | 2526 |
| MCEE_exon_2-utr5_1 | 649 | 1588 | 2527 |
| MCEE_exon_3-utr3_2a | 650 | 1589 | 2528 |
| MCEE_exon_3-utr3_2b | 651 | 1590 | 2529 |
| MLYCD_exon_1-utr-5_2a | 652 | 1591 | 2530 |
| MLYCD_exon_1-utr5_2b | 653 | 1592 | 2531 |
| MLYCD_exon_2_1 | 654 | 1593 | 2532 |

TABLE 2-continued

Target and Primer SEQ ID NOs

| Target Name | Target Sequence SEQ ID No | Forward Primer SEQ ID No | Reverse Primer SEQ ID No |
|---|---|---|---|
| MLYCD_exon_3_1 | 655 | 1594 | 2533 |
| MLYCD_exon_4-utr3_12b | 656 | 1595 | 2534 |
| MLYCD_exon_4-utr3_12j | 657 | 1596 | 2535 |
| MLYCD_exon_4-utr3_12k | 658 | 1597 | 2536 |
| MMAA_exon_1-utr5_2a | 659 | 1598 | 2537 |
| MMAA_exon_1-utr5_2b | 660 | 1599 | 2538 |
| MMAA_exon_2-utr5_1 | 661 | 1600 | 2539 |
| MMAA_exon_3-utr5_2a | 662 | 1601 | 2540 |
| MMAA_exon_4_1 | 663 | 1602 | 2541 |
| MMAA_exon_5-utr5_1 | 664 | 1603 | 2542 |
| MMAA_exon_6-utr3_13a | 665 | 1604 | 2543 |
| MMAB_exon_1-utr5_2b | 666 | 1605 | 2544 |
| MMAB_exon_2-utr5_1 | 667 | 1606 | 2545 |
| MMAB_exon_3-utr5_1 | 668 | 1607 | 2546 |
| MMAB_exon_4-utr3_1 | 669 | 1608 | 2547 |
| MMAB_exon_5-utr3_1 | 670 | 1609 | 2548 |
| MMAB_exon_6-utr3_1 | 671 | 1610 | 2549 |
| MMAB_exon_7-utr3_1 | 672 | 1611 | 2550 |
| MMAB_exon_8-utr3_1 | 673 | 1612 | 2551 |
| MMAB_exon_9-utr3_9a | 674 | 1613 | 2552 |
| MMAB_utr3_2_1 | 675 | 1614 | 2553 |
| MMACHC_exon_1-utr5_1 | 676 | 1615 | 2554 |
| MMACHC_exon_2_1 | 677 | 1616 | 2555 |
| MMACHC_exon_3_1 | 678 | 1617 | 2556 |
| MMACHC_exon_4-utr3_21d | 679 | 1618 | 2557 |
| MMACHC_exon_4-utr3_6a | 680 | 1619 | 2558 |
| MMADHC_exon_1-utr5_2b | 681 | 1620 | 2559 |
| MMADHC_exon_2_1 | 682 | 1621 | 2560 |
| MMADHC_exon_3_1 | 683 | 1622 | 2561 |
| MMADHC_exon_4_1 | 684 | 1623 | 2562 |
| MMADHC_exon_5_1 | 685 | 1624 | 2563 |
| MMADHC_exon_6_1 | 686 | 1625 | 2564 |
| MMADHC_exon_7_1 | 687 | 1626 | 2565 |
| MMADHC_exon_8-utr3_2a | 688 | 1627 | 2566 |
| MMADHC_exon_8-utr3_2b | 689 | 1628 | 2567 |
| MTHFR_exon_10_1 | 690 | 1629 | 2568 |
| MTHFR_exon_11-utr3_14a | 691 | 1630 | 2569 |
| MTHFR_exon_1-utr5_5d | 692 | 1631 | 2570 |
| MTHFR_exon_1-utr5_5e | 693 | 1632 | 2571 |
| MTHFR_exon_2_1 | 694 | 1633 | 2572 |
| MTHFR_exon_3_1 | 695 | 1634 | 2573 |
| MTHFR_exon_4_1 | 696 | 1635 | 2574 |
| MTHFR_exon_5_1 | 697 | 1636 | 2575 |
| MTHFR_exon_6_1 | 698 | 1637 | 2576 |
| MTHFR_exon_7_1 | 699 | 1638 | 2577 |
| MTHFR_exon_8_1 | 700 | 1639 | 2578 |
| MTHFR_exon_9_1 | 701 | 1640 | 2579 |
| MTR_exon_10_1 | 702 | 1641 | 2580 |
| MTR_exon_11_1 | 703 | 1642 | 2581 |
| MTR_exon_12_1 | 704 | 1643 | 2582 |
| MTR_exon_13_1 | 705 | 1644 | 2583 |
| MTR_exon_14_1 | 706 | 1645 | 2584 |
| MTR_exon_15_1 | 707 | 1646 | 2585 |
| MTR_exon_16_1 | 708 | 1647 | 2586 |
| MTR_exon_17_1 | 709 | 1648 | 2587 |
| MTR_exon_18_1 | 710 | 1649 | 2588 |
| MTR_exon_19_1 | 711 | 1650 | 2589 |
| MTR_exon_1-utr5_2a | 712 | 1651 | 2590 |
| MTR_exon_1-utr5_2b | 713 | 1652 | 2591 |
| MTR_exon_2_1 | 714 | 1653 | 2592 |
| MTR_exon_20_1 | 715 | 1654 | 2593 |
| MTR_exon_21_1 | 716 | 1655 | 2594 |
| MTR_exon_22_1 | 717 | 1656 | 2595 |
| MTR_exon_23_1 | 718 | 1657 | 2596 |
| MTR_exon_24_1 | 719 | 1658 | 2597 |
| MTR_exon_25_1 | 720 | 1659 | 2598 |
| MTR_exon_26_1 | 721 | 1660 | 2599 |
| MTR_exon_27_1 | 722 | 1661 | 2600 |
| MTR_exon_28_1 | 723 | 1662 | 2601 |
| MTR_exon_29_1 | 724 | 1663 | 2602 |
| MTR_exon_3_1 | 725 | 1664 | 2603 |
| MTR_exon_30_1 | 726 | 1665 | 2604 |
| MTR_exon_31_3a | 727 | 1666 | 2605 |
| MTR_exon_31_3c | 728 | 1667 | 2606 |
| MTR_exon_32_1 | 729 | 1668 | 2607 |
| MTR_exon_33-utr3_18a | 730 | 1669 | 2608 |
| MTR_exon_4_1 | 731 | 1670 | 2609 |
| MTR_exon_5_1 | 732 | 1671 | 2610 |
| MTR_exon_6-utr3_1 | 733 | 1672 | 2611 |
| MTR_exon_7-utr3_1 | 734 | 1673 | 2612 |
| MTR_exon_8-utr3_1 | 735 | 1674 | 2613 |
| MTR_exon_9-utr3_1 | 736 | 1675 | 2614 |
| MTRR_exon_10_1 | 737 | 1676 | 2615 |
| MTRR_exon_11-utr3_2a | 738 | 1677 | 2616 |
| MTRR_exon_11-utr3_2b | 739 | 1678 | 2617 |
| MTRR_exon_12-utr3_1 | 740 | 1679 | 2618 |
| MTRR_exon_13_2b | 741 | 1680 | 2619 |
| MTRR_exon_14-utr3_1 | 742 | 1681 | 2620 |
| MTRR_exon_15-utr3_4a | 743 | 1682 | 2621 |
| MTRR_exon_1-utr5_1 | 744 | 1683 | 2622 |
| MTRR_exon_2-utr5_1 | 745 | 1684 | 2623 |
| MTRR_exon_3-utr3_1 | 746 | 1685 | 2624 |
| MTRR_exon_4-utr3_1 | 747 | 1686 | 2625 |
| MTRR_exon_5-utr3_1 | 748 | 1687 | 2626 |
| MTRR_exon_6-utr3_1 | 749 | 1688 | 2627 |
| MTRR_exon_7-utr3_1 | 750 | 1689 | 2628 |
| MTRR_exon_8-utr3_1 | 751 | 1690 | 2629 |
| MTRR_exon_9-utr3_1 | 752 | 1691 | 2630 |
| MTRR_utr5_1_2a | 753 | 1692 | 2631 |
| MUT_exon_10_1 | 754 | 1693 | 2632 |
| MUT_exon_11_1 | 755 | 1694 | 2633 |
| MUT_exon_12-utr3_5a | 756 | 1695 | 2634 |
| MUT_exon_1-utr5_2a | 757 | 1696 | 2635 |
| MUT_exon_1-utr5_2b | 758 | 1697 | 2636 |
| MUT_exon_2_1 | 759 | 1698 | 2637 |
| MUT_exon_3_1 | 760 | 1699 | 2638 |
| MUT_exon_4_1 | 761 | 1700 | 2639 |
| MUT_exon_5_1 | 762 | 1701 | 2640 |
| MUT_exon_6_1 | 763 | 1702 | 2641 |
| MUT_exon_7_1 | 764 | 1703 | 2642 |
| MUT_exon_8_1 | 765 | 1704 | 2643 |
| MUT_exon_9_1 | 766 | 1705 | 2644 |
| NAGS_exon_1-utr5_2a | 767 | 1706 | 2645 |
| NAGS_exon_1-utr5_2b | 768 | 1707 | 2646 |
| NAGS_exon_2_1 | 769 | 1708 | 2647 |
| NAGS_exon_3_1 | 770 | 1709 | 2648 |
| NAGS_exon_4_3a | 771 | 1710 | 2649 |
| NAGS_exon_4_3c | 772 | 1711 | 2650 |
| NAGS_exon_5_1 | 773 | 1712 | 2651 |
| NAGS_exon_6-utr3_2a | 774 | 1713 | 2652 |
| OPA3_exon_1-utr5_1 | 775 | 1714 | 2653 |
| OPA3_exon_2-utr3_20a | 776 | 1715 | 2654 |
| OPA3_exon_2-utr3_20b | 777 | 1716 | 2655 |
| OPA3_exon_3-utr3_6a | 778 | 1717 | 2656 |
| OPA3_exon_3-utr3_6b | 779 | 1718 | 2657 |
| OTC_exon_10-utr3_2a | 780 | 1719 | 2658 |
| OTC_exon_1-utr5_1 | 781 | 1720 | 2659 |
| OTC_exon_2_1 | 782 | 1721 | 2660 |
| OTC_exon_3_1 | 783 | 1722 | 2661 |
| OTC_exon_4_1 | 784 | 1723 | 2662 |
| OTC_exon_5_1 | 785 | 1724 | 2663 |
| OTC_exon_6_1 | 786 | 1725 | 2664 |
| OTC_exon_7_1 | 787 | 1726 | 2665 |
| OTC_exon_8_1 | 788 | 1727 | 2666 |
| OTC_exon_9_1 | 789 | 1728 | 2667 |
| PAH_exon_10_1 | 790 | 1729 | 2668 |
| PAH_exon_11_1 | 791 | 1730 | 2669 |
| PAH_exon_12_1 | 792 | 1731 | 2670 |
| PAH_exon_13_1 | 793 | 1732 | 2671 |
| PAH_exon_14-utr3_6a | 794 | 1733 | 2672 |
| PAH_exon_1-utr5_2b | 795 | 1734 | 2673 |
| PAH_exon_2-utr5_1 | 796 | 1735 | 2674 |
| PAH_exon_3_1 | 797 | 1736 | 2675 |
| PAH_exon_4_1 | 798 | 1737 | 2676 |
| PAH_exon_5_1 | 799 | 1738 | 2677 |
| PAH_exon_6_1 | 800 | 1739 | 2678 |

TABLE 2-continued

Target and Primer SEQ ID NOs

| Target Name | Target Sequence SEQ ID No | Forward Primer SEQ ID No | Reverse Primer SEQ ID No |
|---|---|---|---|
| PAH_exon_7_2a | 801 | 1740 | 2679 |
| PAH_exon_8_3c | 802 | 1741 | 2680 |
| PAH_exon_9_2b | 803 | 1742 | 2681 |
| PCBD1_exon_1-utr5_1 | 804 | 1743 | 2682 |
| PCBD1_exon_2_1 | 805 | 1744 | 2683 |
| PCBD1_exon_3_1 | 806 | 1745 | 2684 |
| PCBD1_exon_4-utr3_2a | 807 | 1746 | 2685 |
| PCCA_exon_10_1 | 808 | 1747 | 2686 |
| PCCA_exon_11_1 | 809 | 1748 | 2687 |
| PCCA_exon_12_1 | 810 | 1749 | 2688 |
| PCCA_exon_13_1 | 811 | 1750 | 2689 |
| PCCA_exon_14_1 | 812 | 1751 | 2690 |
| PCCA_exon_15_1 | 813 | 1752 | 2691 |
| PCCA_exon_16_1 | 814 | 1753 | 2692 |
| PCCA_exon_17_1 | 815 | 1754 | 2693 |
| PCCA_exon_18_1 | 816 | 1755 | 2694 |
| PCCA_exon_19_1 | 817 | 1756 | 2695 |
| PCCA_exon_1-utr5_1 | 818 | 1757 | 2696 |
| PCCA_exon_2_1 | 819 | 1758 | 2697 |
| PCCA_exon_20_1 | 820 | 1759 | 2698 |
| PCCA_exon_21_1 | 821 | 1760 | 2699 |
| PCCA_exon_22_1 | 822 | 1761 | 2700 |
| PCCA_exon_23_1 | 823 | 1762 | 2701 |
| PCCA_exon_24-utr3_1 | 824 | 1763 | 2702 |
| PCCA_exon_25_1 | 825 | 1764 | 2703 |
| PCCA_exon_26_1 | 826 | 1765 | 2704 |
| PCCA_exon_27_1 | 827 | 1766 | 2705 |
| PCCA_exon_28-utr3_1 | 828 | 1767 | 2706 |
| PCCA_exon_3_1 | 829 | 1768 | 2707 |
| PCCA_exon_4_1 | 830 | 1769 | 2708 |
| PCCA_exon_5_1 | 831 | 1770 | 2709 |
| PCCA_exon_6_1 | 832 | 1771 | 2710 |
| PCCA_exon_7_1 | 833 | 1772 | 2711 |
| PCCA_exon_8_1 | 834 | 1773 | 2712 |
| PCCA_exon_9_1 | 835 | 1774 | 2713 |
| PCCB_exon_10_1 | 836 | 1775 | 2714 |
| PCCB_exon_11_1 | 837 | 1776 | 2715 |
| PCCB_exon_12_1 | 838 | 1777 | 2716 |
| PCCB_exon_13_1 | 839 | 1778 | 2717 |
| PCCB_exon_14_1 | 840 | 1779 | 2718 |
| PCCB_exon_15_2a | 841 | 1780 | 2719 |
| PCCB_exon_15_2b | 842 | 1781 | 2720 |
| PCCB_exon_16-utr3_1 | 843 | 1782 | 2721 |
| PCCB_exon_17-utr3_1 | 844 | 1783 | 2722 |
| PCCB_exon_18-utr3_1 | 845 | 1784 | 2723 |
| PCCB_exon_19-utr3_12a | 846 | 1785 | 2724 |
| PCCB_exon_19-utr3_12c | 847 | 1786 | 2725 |
| PCCB_exon_1-utr5_1 | 848 | 1787 | 2726 |
| PCCB_exon_2_1 | 849 | 1788 | 2727 |
| PCCB_exon_4-utr5_1 | 850 | 1789 | 2728 |
| PCCB_exon_5_1 | 851 | 1790 | 2729 |
| PCCB_exon_6_1 | 852 | 1791 | 2730 |
| PCCB_exon_7_1 | 853 | 1792 | 2731 |
| PCCB_exon_8_1 | 854 | 1793 | 2732 |
| PCCB_exon_9_1 | 855 | 1794 | 2733 |
| PCCB_processed_transcript_1 | 856 | 1795 | 2734 |
| PPM1K_exon_1-utr5_13d | 857 | 1796 | 2735 |
| PPM1K_exon_1-utr5_13e | 858 | 1797 | 2736 |
| PPM1K_exon_1-utr5_13g | 859 | 1798 | 2737 |
| PPM1K_exon_1-utr5_13h | 860 | 1799 | 2738 |
| PPM1K_exon_2_1 | 861 | 1800 | 2739 |
| PPM1K_exon_3-utr5_1 | 862 | 1801 | 2740 |
| PPM1K_exon_4_1 | 863 | 1802 | 2741 |
| PPM1K_exon_5_1 | 864 | 1803 | 2742 |
| PPM1K_exon_6-utr3_47aa | 865 | 1804 | 2743 |
| PPM1K_exon_6-utr3_47ac | 866 | 1805 | 2744 |
| PTS_exon_1-utr5_1 | 867 | 1806 | 2745 |
| PTS_exon_2-utr5_3a | 868 | 1807 | 2746 |
| PTS_exon_3-utr5_1 | 869 | 1808 | 2747 |
| PTS_exon_4-utr5_2a | 870 | 1809 | 2748 |
| PTS_exon_4-utr5_2b | 871 | 1810 | 2749 |
| PTS_exon_5-utr3_1 | 872 | 1811 | 2750 |
| PTS_exon_6-utr3_2a | 873 | 1812 | 2751 |
| PTS_utr5_1 | 874 | 1813 | 2752 |
| QDPR_exon_1-utr5_1 | 875 | 1814 | 2753 |
| QDPR_exon_3-utr3_1 | 876 | 1815 | 2754 |
| QDPR_exon_4-utr3_1 | 877 | 1816 | 2755 |
| QDPR_exon_5_1 | 878 | 1817 | 2756 |
| QDPR_exon_6-utr3_2a | 879 | 1818 | 2757 |
| QDPR_exon_7-utr3_3a | 880 | 1819 | 2758 |
| SLC22A5_exon_1-utr5_2a | 881 | 1820 | 2759 |
| SLC22A5_exon_1-utr5_2b | 882 | 1821 | 2760 |
| SLC22A5_exon_2_6f | 883 | 1822 | 2761 |
| SLC22A5_exon_3_15a | 884 | 1823 | 2762 |
| SLC22A5_exon_3_15o | 885 | 1824 | 2763 |
| SLC22A5_exon_4-utr3_1 | 886 | 1825 | 2764 |
| SLC22A5_exon_5-utr3_1 | 887 | 1826 | 2765 |
| SLC22A5_exon_6-utr3_6a | 888 | 1827 | 2766 |
| SLC22A5_exon_6-utr3_6f | 889 | 1828 | 2767 |
| SLC22A5_exon_7-utr3_1 | 890 | 1829 | 2768 |
| SLC22A5_exon_8-utr3_1 | 891 | 1830 | 2769 |
| SLC22A5_exon_9-utr3_4a | 892 | 1831 | 2770 |
| SLC25A13_exon_10_1 | 893 | 1832 | 2771 |
| SLC25A13_exon_11_1 | 894 | 1833 | 2772 |
| SLC25A13_exon_12_1 | 895 | 1834 | 2773 |
| SLC25A13_exon_13_1 | 896 | 1835 | 2774 |
| SLC25A13_exon_14_1 | 897 | 1836 | 2775 |
| SLC25A13_exon_15_1 | 898 | 1837 | 2776 |
| SLC25A13_exon_16_1 | 899 | 1838 | 2777 |
| SLC25A13_exon_17-utr3_3a | 900 | 1839 | 2778 |
| SLC25A13_exon_1-utr5_1 | 901 | 1840 | 2779 |
| SLC25A13_exon_2-utr5_1 | 902 | 1841 | 2780 |
| SLC25A13_exon_3-utr5_1 | 903 | 1842 | 2781 |
| SLC25A13_exon_4_1 | 904 | 1843 | 2782 |
| SLC25A13_exon_5-utr3_1 | 905 | 1844 | 2783 |
| SLC25A13_exon_6_1 | 906 | 1845 | 2784 |
| SLC25A13_exon_7_1 | 907 | 1846 | 2785 |
| SLC25A13_exon_8_1 | 908 | 1847 | 2786 |
| SLC25A13_exon_9_1 | 909 | 1848 | 2787 |
| SLC25A13_processed_transcript_2_1 | 910 | 1849 | 2788 |
| SLC25A20_exon_1-utr5_1 | 911 | 1850 | 2789 |
| SLC25A20_exon_2-utr5_1 | 912 | 1851 | 2790 |
| SLC25A20_exon_3-utr3_1 | 913 | 1852 | 2791 |
| SLC25A20_exon_4-utr3_1 | 914 | 1853 | 2792 |
| SLC25A20_exon_5-utr3_1 | 915 | 1854 | 2793 |
| SLC25A20_exon_6-utr3_1 | 916 | 1855 | 2794 |
| SLC25A20_exon_7-utr3_1 | 917 | 1856 | 2795 |
| SLC25A20_exon_8-utr3_1 | 918 | 1857 | 2796 |
| SLC25A20_exon_9-utr3_3a | 919 | 1858 | 2797 |
| TAT_exon_1_4a | 920 | 1859 | 2798 |
| TAT_exon_1_4b | 921 | 1860 | 2799 |
| TAT_exon_2_1 | 922 | 1861 | 2800 |
| TAT_exon_3_1 | 923 | 1862 | 2801 |
| TAT_exon_4_1 | 924 | 1863 | 2802 |
| TAT_exon_5_1 | 925 | 1864 | 2803 |
| TAT_exon_6_1 | 926 | 1865 | 2804 |
| TAT_exon_7_1 | 927 | 1866 | 2805 |
| TAT_exon_8_1 | 928 | 1867 | 2806 |
| TAT_exon_9-utr3_9a | 929 | 1868 | 2807 |
| TAT_exon_9-utr3_9b | 930 | 1869 | 2808 |
| TAZ_exon_1-utr5_2b | 931 | 1870 | 2809 |
| TAZ_exon_2_2a | 932 | 1871 | 2810 |
| TAZ_exon_3-utr3_3b | 933 | 1872 | 2811 |
| TAZ_exon_3-utr3_3c | 934 | 1873 | 2812 |
| TAZ_exon_5-utr3_5c | 935 | 1874 | 2813 |
| TAZ_exon_5-utr3_5d | 936 | 1875 | 2814 |
| TAZ_exon_5-utr3_5e | 937 | 1876 | 2815 |
| TAZ_exon_6-utr3_1 | 938 | 1877 | 2816 |
| TAZ_exon_7-utr3_3a | 939 | 1878 | 2817 |

TABLE 4

DNA Sequencing and Metabolic Data Analysis in 80 Newborns

| DBS ID | Condition | RUSPseq | P/LP in 8 MMA genes | VUS in 8 MMA genes | PMID for 8 MMA | P/LP in 64 RUSPseq | PMID for 64 genes |
|---|---|---|---|---|---|---|---|
| A1 | mut⁰ | MUT: P/LP | MUT (c.C682T:p.R228X)#  (c.C581T:p.P194L); LMBRD1 (c.G1464A:p.W488X); MMACHC (c.A452G:p.H151R)# | — | 15643616, 20631720, 27060300, 27233228 | | |
| B1 | mut⁰ | MUT: P/LP, MMAA: P/P | MUT (c.T1620A:p.C540X)#, (c.C322T:p.R108C)#; MMAA (c.G3A:p.M1I), (c.931delA:p.K311fs) | — | 19862841, 16281286, 20301409 | — | |
| C1 | mut⁰ | MUT: P/P | MUT (c.C982T:p.L328F*Hom)# | — | 15643616, 25125334 | | |
| D1 | mut⁰ | MUT: P/LP | MUT (c.678_679insAATTTATG: p.V227fs)#, (c.G607A:p.G203R)#; LMBRD1 (c.G879A:p.W293X); MMAB (c.137delC:p.P46fs) | — | 15781192, 23045948, 10923046, 19375370, 17432548 | | |
| E1 | mut⁰ | MUT: LP/LP | MUT (c.C1843A:p.P615T), (c.C422T: p.A141V); MCEE (c. −245 − 1G > A) | — | 28973083 | | |
| F1 | mut⁰ | MUT:P/VUS | MUT (c.C682T:p.R228X)# | MUT (c.1846C > T:p.R616C) | 15643616 | | |
| G1 | mut⁰ | QC: low read depth | — | — | — | | |
| H1 | mut⁰ | MUT: P/P | MUT (c.C693G:p.Y231X)#, c.1399C > T (p.R467X)# | — | 27167370, 25736335, 23430940, 15643616, 12402345, 22727635 | | |
| A2 | mut⁰ | MUT: P/P | MUT (c.G607A:p.G203R*Hom)#; MMAB (c.T2A:p.M1K); MMADHC (c.509delA:p.N170fs) | — | 10923046, 19375370, 17432548 | | |
| B2 | mut⁰ | False negative (MUT: P/−) | MUT (c.C454T:p.R152X)# | — | ClinVar | | |
| C2 | mut⁰ | MUT: P/P | MUT (c.1891delG:p.A631fs)#, (c.678_679insAATTTATG: p.V227fs)#; MMAB (c.135 − 2A > G) | — | 16281286, 15781192, 23045948 | PAH (c.G1243A: p.D415N)#, (c.C498A: p.Y166X) | 9781015, 7556322 |
| D2 | mut⁰ | MUT: P/P | MUT (c.2194_2197delGCCG/insAAGGT)#, (c.C682T:p.R228X)#; MMAA (c.A829G:p.R277G) | — | 15643616, 10923046 | | |
| E2 | mut⁰ | MUT: LP/P | MUT (c.C322T:p.R108C)#, (c.C682T:p.R228X)# | — | 20301409, 16281286, 15643616 | | |
| F2 | mut⁰ | MUT: LP/LP | MUT (c.G607A:p.G203R*Hom)#; MMACHC (c.401_402del:p.D134fs) | — | 10923046, 19375370, 17432548 | | |
| G2 | mut⁰ | MUT: P/P | MUT (c.G1560C:p.K520N*Hom)#; MMAB (c.T426A:p.Y142X) | — | 17075691 | | |
| H2 | Cbl C, D, F | MMACHC: P/LP | MMACHC (c.326_329del:p.P109fs)#, (c.G482A:p.R161Q)# | — | ClinVar | | |
| A3 | Cbl C, D, F | MMACHC: P/P | MMACHC (c.271dupA:p.V90fs)#, (c.C615G:p.Y205X)# | — | 19370762, 20631720, 25687216, 20631720 | | |
| B3 | Cbl C, D, F | MMACHC: P/P | MMACHC (c.82 − 2A > G), (c.G609A:p.W203X)# | — | 19370762, 16311595 | | |
| C3 | Cbl C, D, F | MMACHC: P/LP/P | MMACHC (c.C28T:p.Q10X), (c.T578C:p.L193P)#, (c.G608A:p.W203X)#; MCEE (c.G428A:p.R143H); MUT (c.G1897A:p.V633I) | — | 19370762, 16311595 | | |
| D3 | Cbl C, D, F | QC: failed DNA extraction | — | — | — | | |
| E3 | Cbl C, D, F | MMACHC: P/LP | MMACHC (c.271dupA:p.V90fs)#, (c.T578C:p.L193P)# | — | 19370762, 20631720, 16311595 | | |
| F3 | Cbl C, D, F | False negative (−/−) | — | MMACHC (c.T176C:p.F59S) | — | | |
| G3 | Cbl C, D, F | MMACHC: P/P | MMACHC (c.271dupA:p.V90fs*Hom)#; MUT (c.T2099C:p.M700T) | — | 19370762, 20631720 | | |

TABLE 4-continued

DNA Sequencing and Metabolic Data Analysis in 80 Newborns

| DBS ID | Condition | RUSPseq | P/LP in 8 MMA genes | VUS in 8 MMA genes | PMID for 8 MMA | P/LP in 64 RUSPseq | PMID for 64 genes |
|---|---|---|---|---|---|---|---|
| H3 | Cbl C, D, F | MMACHC: P/LP | MMACHC (c.326_329del:p.P109fs)#, (c.G482A:p.R161Q)#; MMAA (c.672delA:p.T224fs); MMADHC (c.G170A:p.W57X) | — | 19370762 | | |
| A4 | Cbl C, D, F | MMACHC: P/LP | MMACHC (c.567dupT:p.R189fs)#, (c.G482A:p.R161Q)# | — | 19370762, 21835369 | | |
| B4 | Cbl C, D, F | MMACHC: P/P | MMACHC (c.326_329del:p.P109fs*Hom)#; MCEE (c.T305A:p.L102X); MMAB (c.A653T:p.D218V); MUT (c.C1849T:p.L617F) | — | ClinVar | PCCA (c.1070delG: p.R357fs), (c.1963-2A>G) | |
| C4 | Cbl C, D, F | MMACHC: P/P | MMACHC (c.G608A:p.W203X*Hom)# | — | 27167370, 19370762, 16311595 | MTHFR (c.C778T:p.Q260X), (c.G160T:p.E54X) | |
| D4 | Cbl C, D, F | MMACHC: P/P | MMACHC (c.434dupT:p.I145fs), (c.271dupA:p.V90fs)# | — | 19370762, 20631720 | | |
| E4 | Cbl C, D, F | MMACHC: P/P | MMACHC (c.271dupA:p.V90fs*Hom)# | — | 19370762, 20631720 | | |
| F4 | Cbl C, D, F | False negative (MMADHC: P/-) | MMADHC (c.680delC:p.P227fs) | — | — | | |
| G4 | Control | — | — | — | — | | |
| H4 | Control | — | — | — | — | | |
| A5 | Control | — | — | — | — | | |
| B5 | Control | — | MMADHC (c.T610C:p.F204L) | — | — | | |
| C5 | Control | — | — | — | — | | |
| D5 | Control | — | — | — | — | | |
| E5 | Control | — | — | — | — | | |
| F5 | Control | — | — | — | — | | |
| G5 | Control | — | MMAA (c.562 + 2T > C) | — | — | | |
| H5 | Control | — | MUT (c.C890T:p.T297I) | — | — | | |
| A6 | Control | — | MMAB (c.305delT:p.L102X) | — | — | | |
| B6 | Control | — | — | — | — | | |
| C6 | Control | — | — | — | — | | |
| D6 | Control | — | — | — | — | | |
| E6 | Control | — | MMACHC (c.259 – 2A > T) | — | — | | |
| F6 | Control | — | — | — | — | | |
| G6 | Control | — | — | — | — | | |
| H6 | Control | — | — | — | — | PAH (c.A204T: p.R68S)#, (c.A286T: p.K96X) (variants in cis) | 26666653, 23764561, 23500595 |
| A7 | Control | — | MMAA (c.C1114T:p.Q372X) | — | — | | |
| B7 | Control | — | — | — | — | | |
| A8 | MMA.FP | — | MMAA (c.G1079C:p.R360P) | — | — | | |
| B8 | MMA.FP | — | MMAB (c.644 + 1G > C) | — | — | MLYCD (c.C886T: p.Q296X), (c.799 – 2A > T) (variants in cis) | — |
| C8 | MMA.FP | — | — | — | — | | |
| D8 | MMA.FP | — | — | — | — | | |
| E8 | MMA.FP | — | MUT (c.C1741T:p.R581X)# | — | 27233228 | | |
| F8 | MMA.FP | — | — | — | — | | |
| G8 | MMA.FP | — | — | — | — | | |
| H8 | MMA.FP | — | — | — | — | | |
| A9 | MMA.FP | — | MMAA (c.A1072T:p.K358X) | — | — | | |
| B9 | MMA.FP | — | — | — | — | | |
| C9 | MMA.FP | — | — | — | — | | |
| D9 | MMA.FP | — | — | — | — | | |
| E9 | MMA.FP | — | LMBRD1 (c.C811T:p.Q271X) | — | — | | |
| F9 | MMA.FP | — | MUT (c.G278A:p.R93H)# | — | 1670635 | | |
| G9 | MMA.FP | — | MMAB(c.585 – 1G > A)# | — | 22695176 | | |
| H9 | MMA.FP | — | MUT (c.C1237T:p.Q413X) | — | — | HPD (c.832 – 2A > T), (c.241 + 2T > C) | |
| A10 | MMA.FP | — | MMAB (c.349 – 2A > T) | — | — | | |
| B10 | MMA.FP | — | MMACHC (c.463delG:p.G155fs) | — | — | | |
| C10 | MMA.FP | — | MCEE (c.85 – 2A > G) | — | — | ACADVL (c.174delC: | |

TABLE 4-continued

DNA Sequencing and Metabolic Data Analysis in 80 Newborns

| DBS ID | Condition | RUSPseq | P/LP in 8 MMA genes | VUS in 8 MMA genes | PMID for 8 MMA | P/LP in 64 RUSPseq | PMID for 64 genes |
|---|---|---|---|---|---|---|---|
| D10 | MMA.FP | — | — | — | — | p.G58fs), (c.62 + 2T > C) | |
| E10 | MMA.FP | LMBRD1: P/VUS (variants in cis) | LMBRD1 (c.C1321T:p.Q441X); MMAB (c.621delG:p.A207fs); | LMBRD1 (c.C1242T: p.C414C) | — | FAH (c.788delT: p.V263fs), (c.930delG: p.Q310fs) | |
| F10 | MMA.FP | — | LMBRD1 (c.T2C:p.M1T); MMACHC (c.362delC:p.A121fs) | — | — | | |
| G10 | MMA.FP | — | LMBRD1 (c.G1464A:p.W488X) | — | — | CPS1 (c.G741A: p.W247X), (c.C1891T: p.Q631X) | |
| H10 | MMA.FP | MUT: P/LP (variants in cis) | MUT (c.1818delA:p.K606fs), (c.G1810A:p.V604I) | — | — | | |
| A11 | MMA.FP | — | — | — | — | DBT (c.A31G: p.S11G), (c.889delA: p.I297fs) | |
| B11 | MMA.FP | — | — | — | — | | |
| C11 | MMA.FP | QC: failed DNA extraction | — | — | — | | |
| D11 | MMA.FP | — | MMAA (c.534_535del:p.A178fs) | — | — | GALT (c.569delG: p.W190fs) | |
| E11 | MMA.FP | — | — | — | — | NAGS(c.732delC: p.D244fs), (c.1399_1400i nsC:p.D467fs), (c.A1605G: p.X535W) | |
| F11 | MMA.FP | — | — | — | — | | |

Condition: mut$^0$ = methylmalonyl-CoA mutase mut 0 enzymatic subtype; Cbl C, D, F = cobalamin deficieny type C, D and F. Control = healthy controls sample. FP = false positive case
RUSPseq: Reportable finding with gene name and identified variants. P = pathogenic; LP = Likely pathogenic; VUS = variant of unknown significance; QC = quality control.
P/LP in 8 MMA genes: Gene names in bold indicate genes identified with two P/LP in 1 gene. ($^#$) = known pathogenic variant in ClinVar or PubMed.
VUS in 8 MMA genes: VUS are reported for TP and FP samples with only 1 P/LP in a MMA gene.
P/LP in 64 RUSPseq genes: Variants identified in 64 genes other than the 8 MMA genes. ($^#$) = known pathogenic variant in ClinVar or PubMed.

SEQUENCE LISTING (2826 sequences)

SEQ ID NO: 1 - DNA, 350 bp, Homo sapiens
cacctgggttgttagggctcgtgggaggactacaacccccagggtgcagtgggacaggcgttgccgggtcgcaggtcccgccagtgcgagcgcaacggaggtcgaaggcgttcagactcttagctgaacgcggagctgcggcggctatgctgtggagcggctgccggcgtttcggggcgcgcctcggctgcctgcccggcggtctccgggtcctcgtccagaccggccaccggagcttgacctcctgcatcgaccgtaaggatctcctggcgggcagtaggacaggtgtccagaaccccggcggacatatgtccgcgaggggctgcagtctccccgttccatccagtcac

SEQ ID NO: 2 - DNA, 450 bp, Homo sapiens
tggcaacactgaccctgtcctagaacagtatatgcaatcctgcccacagcttccatgggacttaatgaagagcagaaagaatttcaaaaagtggcctttgactttgctgcccgagagatggctccaaatatggcagagtgggaccagaaggtaggcgtttttcttgtgcttagacgttctaacaacagatgtctcaggcagacctttatctttgtctcctgataatgtaattgttaaatgtctcctccacttaccaactcttactgcaagtgagaataccggtagtggatgatttttcctagaaggcatcctgatcatcttgtacataactttttttttgttagttgaataaagatttggatataaaactaaggcagttctatagataataaaaagaaacttcttaatgccagaacaagtttttacaggacccatgttaactgataacca

SEQ ID NO: 3 - DNA, 429 bp, Homo sapiens
acctcagcctggttatctctgggtagtccttattccaggaatatgttttaatccaccgtttgcctttaaagagtcttcccaattgtgactctccccttcccactcttctgctttactccactgccctgccctttgttctctttccccttctcccccatttttttttcttttccatctttatttctgtcattgtcttttcttcttggtgtacctatcagcatgtgtgcctggatgattgatagcttcggaaatgaggaacagaggcacaaattttgcccaccgctctgtaccatggagaagtttgcttcctactgcctcactgaaccaggtgaatttgccacactgcactgagatatagcagggagagatgcttcctgctcagatggcattaccgagcactccttccagcctcttgacatgtcgagccac

SEQ ID NO: 4 - DNA, 438 bp, Homo sapiens
agagttcctttggccacttgggttttgcagtgacacactctgagcagggtctgtttagagaagatttcctagaagatagaattgtgctgggctccctcgacctcactgactttctcaccttctctctgctgccttttgatccctcctcaggaagtgggagtgatgctgcctctcttctgacctccgctaagaaacagggagatcattacatcctcaatggctccaaggtactagcgtgcgtcctcccagagcactttggagattgttcccagcttcctcctgacatcctctggttccttcacatccgcgggttaatactcccataggatttttatgtgttgggaagagaacctctgacccatttctctttctttattctcactgtttgtatctctcctaatctgattccagatcatttcgttgacttttgtctatcct

SEQ ID NO: 5 - DNA, 447 bp, Homo sapiens
ttctcactgtttgtatctctcctaatctgattccagatcatttcgttgacttttgtctatcctttttatactctcttggactgcctctctgatctgcagtcactgcagcgaccttttacctcacctcagtctctgtgccattggaccttattgtcagtctctgtgccattggaccttattgtcagtctctgtgccattggaccttattgtcagtctctgtgccattggaccttattgtcagtctctgtgccattggaccttattgtcagtctctgtgccattggaccttattgtcaggaggacccagtggtgttcccagacgctgtgagaactcaagcattccctggtccttttgcaccccttttacccccacaggccttcatcagtggtgctggtgagtcagacatctatgtggtcatgtgccgaacaggaggaccaggccccaag

SEQ ID NO: 6 - DNA, 446 bp, Homo sapiens
cagtggtgctggtgagtcagacatctatgtggtcatgtgccgaacaggaggaccaggccccaagggcatctcatgcatagttgttgagaaggggacccctggcctcagctttggcaagaaggagaaaaaggtgagtggctgttggacaggaaacaattcaggttatgagactctgccacctgccagcccaactcctgctctatttcagaaaacaggtttgcatacttgctaacctacctttgaagcagttgcttctattaggattttcaacaggagcatatgaaatacaacagggcattattaaacactaggcctctggggaaagtgacaatgtttgccagtaaattcttcaagccacctgtgagtgttctgacctctcctgcctctgcttttggcctgtgttccttatccagctgcttacgttggtgcactttgttgctccagga

SEQ ID NO: 7 - DNA, 434 bp, Homo sapiens
agttgtgagaagtgtttgtaggttagtcaggtagagtagacattagtagattctcttaataagttagaaaatgtttagctgaaacaggtatctttctgagtgctgacaggcctttaaacctgaactttttctttttcctcattttaagttcttgtgggtctaagtcttgggtgctgaaacccatacctcacaggctcccgtccccagggaaggccgccctacctgctggattgttgggcaaccacgcagtccctgatttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtag

SEQ ID NO: 8 - DNA, 412 bp, Homo sapiens
tttttgccaggtggggtggaactcccagccaacacgagctgtgatcttcgaagactgtgctgtccctgtggccaacagaattgggagcgaggggcagggcttcctcattgccgtgagaggactgaacggagggaggatcaatattggtgagatacgcaggggtgtggcagggaggtagcggtccgggacaggcactgctgttttccagcttggttggaacgtcggcgctcttcccctctagcttcctgctccctgggggctgcccacgcctctgtcatcctcacccgagaccacctcaatgtccggaagcagtttggagagcctctggccagtaaccaggtaacctctgccttgcctccacatggctttgcactatttgcagcccgggacctgctctagggcccacatttcc

SEQ ID NO: 9 - DNA, 449 bp, Homo sapiens
tcccaccactgtcctagccagagcttgtgctttatttctgtccatcttttcttgggatatctttaacgatattaaagtgtcgggtgagtgaagtggacttagcacttaaaagcaataaatttcctctatagaaaaagcaagagactttgaagctttggatcacttagaaaaggcgcctccgagatgtcttaccgaggctcctgcaccaggtgctggtctaagcccctcagtcttgtctggttctctgctccctgtgctgcagtacttgcaattcacactggctgatatggcaacaaggctggtggccgcgcggctgatggtccgcaatgcagcagtggctctgcaggaggagaggaaggatgcagtggccttgtgctccatggccaagctctttgctacagatgaatgctttgccgtaagtgattcctctggctctcctgggatggaca

SEQ ID NO: 10 - DNA, 428 bp, Homo sapiens
gcctatgtgggagctctcatcgctggcttttaggcctgctgcatgccattatacacttcattatgtcactgttgtttggttgtgttctaggcgagaaaccacctttggaaggttcacagcagccccaatttagcactctgccatgtttacattgtcaggctgcattgccactagggggaaccatagctttttatcatcccagccagggtggctgtgggcagcttctgcctggcaggtaataagggagaggggcagagggctttgagtcgcctgtctggggggaactgacaagtttagtaggtgaacttcccttgtctctaaccatacagaatgtggaggccctctttgagcttggctgtttgtggttctttcatgggtttatggcgggctgccagatcgtgggctggggtaggaagggaagctgcttg

SEQ ID NO: 11 - DNA, 372 bp, Homo sapiens
tgtggaggccctctttgagcttggctgtttgtggttctttcatgggtttatggcgggctgccagatcgtgggctggggtaggaagggaagctgcttgctccacagtcttcccagagtccaagacgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacgggggcgggatcgctgctttccccactctctgtccccatgcctcctgggcctcagggtgcagtcaagccctgtctgtctcgagg

SEQ ID NO: 12 - DNA, 429 bp, Homo sapiens
cgtctagtccctgtctccctgcagatctgcaaccaggccttgcagatgcacgggggctacggctacctgaaggattacgctgttcagcagtacgtgcgggactccagggtccaccagattctagaaggtaaaaattgccagaggttattctcttcccttcagaacgggggcgggatcgctgctttccccactctctgtccccatgcctcctgggcctcagggtgcagtcaagccctgtctgtctcgaggcttcctcctccctcccgttccgcagagctgttctggcaggggcctggagtccagagccgcagcttcgtccctttcggggggcctcagatcgctctgctgctgcccttttcctctggagatctgcgagaagggtgaactgagataatggatgagaaagcatgttgaaaaccacagccgggg

SEQ ID NO: 13 - DNA, 426 bp, Homo sapiens
ctctgctgctgcccttttcctctggagatctgcgagaagggtgaactgagataatggatgagaaagcatgttgaaaaccacagccggggcttttctctaaggttatcgagtacgtggttctcagggatccaagaacagtgatggacaaggcaaatgtgagccagtatggtcatcagtagctctatattgattatcagccagatggcctaaaagatacctgtctcaatattactagtgtatttttcaataaaataaaccatcactatatgggtatcttcttggtagtcacagacattctatcgaggaaacatggaagccgttggggtcgggctcggagcctggctgtctccactctctacagccagtgcggaagtcttgaaatgacacgactcttggaaaagcaggaggggcagaggcttctttgag

SEQ ID NO: 14 - DNA, 442 bp, Homo sapiens
ctctgaactaggcctggagcagcctggtcagagctttactaaactctcagactttgctgctgtgaaattcttcctccttcctccctcttacaggtagcaatgaagtgatgaggatactgatctctagaagcctgcttcaggagtagaacccacacttgttctggcctggtgttcagtgcgactgcagtcagtgttgagtggtgccatgtgggccgctctattccaaaggaatcatggattagacccaagggctgagctcctctagggcaggacctgcaccctgtgtgttggcaccagcatcgggtcttggactggggcagaatccccagtggaaccggaagagctggactgatgagaaacatcagaagaacacatactaccttgttttcctaatgccagaagggtgaccagtgaagattcaccgtcaaaccatgaaagtcct

SEQ ID NO: 15 - DNA, 363 bp, Homo sapiens
tgaaaaagccccaggaaaaaacttttaagttttctcaataaatatcctttaatttttttctttttaattctagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcaggtaaggttaaagatgatttttttggtttgcaaggagagaga

SEQ ID NO: 16 - DNA, 436 bp, Homo sapiens
tgctgtgcagatacttggaggcaatggatttaatacagaatatcctgtagaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgacaact

SEQ ID NO: 17 - DNA, 444 bp, Homo sapiens
tgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggct

SEQ ID NO: 18 - DNA, 378 bp, Homo sapiens
ccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtgagagggagcccagcggtgcggtggggctggaacatgggtattgtggtgtcggagcagg

SEQ ID NO: 19 - DNA, 353 bp, Homo sapiens
tggtcaaaccagttgctgtactcacttatgattatcagtagtctcttatctgattaatgtttaacttatcaaatttattttaataaaagtgttctttacaggtcctgagaagtatttctcgttttcattggagatcacagcatacaaaagccaatcgacaacgtgaaccaggattaggatttagttttggtatatgttcggttctatcttttgactttaaacttatacatatgaagctttatatgttttgtttggaatatgtttgtaaataaacttaataatgtctttcaatgagtagaaccagtccactgtccacagataatttacaataactcacactccattcttcctga

SEQ ID NO: 20 - DNA, 403 bp, Homo sapiens
tgtgtagtgaactcttgattagtcaaaaaatgcactgtagtctgagtttctgataatcaaggatttaagtccccacaataaatacacatttctacatactgacttcataggacatttttccttgttatccagttttaacttttctaaataattttcccttagagttcaccgaacagcagaaagaatttcaagctactgctcgtaaatttgccagagaggaaatcatcccagtggctgcagaatatgataaaactggtgaagtaggtatatacattttaaagagggaaaaatcttttacattttttacaagattatgtaatcaaactatctggatttcaaaatatattttaactcagttctttttcttctagtatccagtccccctaattagaagagcctggga

SEQ ID NO: 21 - DNA, 449 bp, Homo sapiens
ggaaatcatcccagtggctgcagaatatgataaaactggtgaagtaggtatatacattttaaagagggaaaaatcttttacattttttacaagattatgtaatcaaactatctggatttcaaaatatattttaactcagttctttttcttctagtatccagtccccctaattagaagagcctgggaacttggtttaatgaacacacacattccagagaactgtggtaagctttctttatatttttaatactggaatgcatatgagtaagaaaaattgtggaactctactcagtcatttttttcaaatatttcttgccattaaatgactttctacctttgtcttcctgctcagactacagtgtttgcccacttttggaagcttgcactctatacctagatgcgtttttccttcttctaactggttccaaccttaacttgcacctaaacct

SEQ ID NO: 22 - DNA, 355 bp, Homo sapiens
tgctcagactacagtgtttgcccacttttggaagcttgcactctatacctagatgcgtttttccttcttctaactggttccaaccttaacttgcacctaaaccttggtaacttccgtttctagagttggtcaatttgttgtgttttattcctatcttctatattacattttattgagtcttttttgtgaaccatgattcttttcctcagacccagttttagagttgaattgagttttaacaaaatcaagttagaacaggaatacaggttcaaattacaaatagtaaaataattttttgaaaattttagagctttaagaaagtataatttcttattgtgccagccagaacacatgt

SEQ ID NO: 23 - DNA, 438 bp, Homo sapiens
accatgattcttttcctcagacccagttttagagttgaattgagttttaacaaaatcaagttagaacaggaatacaggttcaaattacaaatagtaaaataattttttgaaaattttagagctttaagaaagtataatttcttattgtgccagccagaacacatgtagatattatattgcaaatttccttttaaaacaaattttggtcatattgaaagcaattaaaatagtttacctttatttctattgtgatgtactacatattacaatgtgttgaaacattttgatactgtaggaggtcttggacttggaacttttgatgcttgtttaattagtgaagaattggcttatggatgtacaggggttcagactgctattgaaggaaattctttgggggtaagtgacttagaaaattaactacctaactcagctcttgtt

SEQ ID NO: 24 - DNA, 445 bp, Homo sapiens
tgccacaggtcctacatataacctaattttatgaaaatacttagattagcagatttatttcctcattctaacttagaggcaaggtataggccagttctttggacttacctgttaggtgaaaaatagttattttttcattttgaattatagcatctctgaatttacatatccaataaaaatgacttgattttttaatgtcaattttcttcggtagcaaatgcctattattattgctggaaatgatcaacaaaagaagaagtatttggggagaatgactgaggagccattgatgtgtgtgagtatgtgtaactgccgctttatttcacacttaagaagggaacaaaggtgctatttctccttttcagtctatatgtatatattgggatatttagcattgaaacaaaacttagcaacatattattacaatgatgtgtcaaggatgcca

SEQ ID NO: 25 - DNA, 407 bp, Homo sapiens
ttgagtggtttctttgattttgtaagaacattttaattttagatatttaaaaatatttaaaatacagcttaaaaaataaaacaatcctgtttccaaacagtcaaaatttaatcactaacatttaatttcatttctcttgtttttatatattcaaggcttattgtgtaacagaacctggagcaggctctgatgtagctggtataaagaccaaagcagaaaagaaaggagatgagtatattattaatggtcagaagatgtggataaccaacggaggaaaagctaattggtatgttgttcaaaacatctttgtatattttttcttaattgttttatcttcaaatctctctttctttctgtatatttttaaaccactacagttaaggtatgtttgtggaactggaaggcct

SEQ ID NO: 26 - DNA, 439 bp, Homo sapiens
gcttgagctggggaagtcgagactgcagtgagccaagatcatgccactgtactccagcctgcgcaacagagtgagatcttgtctaaaaaaaaaaagttatgtaaatgtcctctttgtctttcaaaatatcatatatactgtactgcgggtaactgaaaccacagaaagtgaaaccccatggaatgggggagggcctactgtgttattaagacatagacctcaaatactagctcttccatatactaggtacgtgactaggcaagtttttaaacctgattatttatttcctcatttgtaaaatgtaggtaataataattgggattgttaagagaattaactgagagagcaatcaccatgtgttatttgccgatattatcaccattatccggtatgtgtatctcttaggtattttttattggcacgttctgatccagatcct

SEQ ID NO: 27 - DNA, 394 bp, Homo sapiens
agcaatcaccatgtgttatttgccgatattatcaccattatccggtatgtgtatctcttaggtattttttattggcacgttctgatccagatcctaaagctcctgctaataaagcctttactggattcattgtggaagcagataccccaggaattcagattgggagaaaggtaaagtatttattaatgattagggccccaaatattattttaattataaattgcaaaattacttaactttcctttaataaaaacatttgtttgtattaagttggagtaaaaataaagctatgttttgatgatattagatcaaatagtctatatactactgaagattttgtgaacagtcatttcaagtcattttgaaagagtagtaccaacctgtggagaaggct

SEQ ID NO: 28 - DNA, 360 bp, Homo sapiens
tgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctct

SEQ ID NO: 29 - DNA, 430 bp, Homo sapiens
ggtcttctccctcctgagccactgttctcatctcaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggc

SEQ ID NO: 30 - DNA, 439 bp, Homo sapiens
cagtcgagcgtcggttcctcgccttgggagggaccactggaggccccgccccctggccgcgagcgcacctcggccccgctcccgaggccctacgggcgtggcctctgtcccgggtcccgccccccagcactccggaacagcgcgctcgcagcgggaggtcgcgaagcctgggactgtgtctgtcgcccatggccgccgcgctgctcgcccgggcctcgggccctgcccgcagaggtgagtgcgctggggatccgtacggcggggcttcagcccgcgtctggcccagcgggcggaggtcctggcggccggctctgtcagagccgctggcaggcggagccccactccgggagcgctcacggcctttgccccagttctgctgctccttgcgccgacccagcccggcccttcaggcgtccctggttcctgcacagacccctac

SEQ ID NO: 31 - DNA, 368 bp, Homo sapiens
ctcctgcctcctccttccactcacttctgcccttgccggcagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgagagtgcaacctcagcagcccacgatagtggtctgccctctgctactggatgaatggtggcagtgacagtcagcggcactcggactctggtagaggaaccccaaagcagggcctggaacccagaaaatgctctggaagtttcccttgtccagcctgtgg

SEQ ID NO: 32 - DNA, 425 bp, Homo sapiens
ctggggtcacatggcctgagtttctgcagggcactgcctcgggggcaggagggtttgggcttggggagggtgggctcgcccccggcagctgcccatggcgtgccgtccttccctgtgcccaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaacgtgagccccctcccaggcccctgggacacacgggtggagggaggctcccgtgagcgggcaggctctggcctcggctcccagccctgatctctctggagacgtcacaggccttggtcctactgggtaggccctggacagaacaggccctgaggt

SEQ ID NO: 33 - DNA, 446 bp, Homo sapiens
tctctggagacgtcacaggccttggtcctactgggtaggccctggacagaacaggccctgaggtgcagcccgcaggtgggcaggatgcgcctgggcctggggcctccgaccgctccccgctgtcctcctagtctctctacctggggcccatcttgaagtttggctccaaggagcagaagcaggcgtgggtcacgcctttcaccagtggtgacaaaattggctgctttgccctcagcgaaccaggtacctgccctgtcccctcacctgtccttagggtgacaggcccagaggggaggagaggaaggtgctaggccaactgcccactgcttcggaggccagaggggaggctccccgtgtggttggtagggtgagcgctcttgccaccgcggcgctgggaggaagattgccttcggggtcccctggtttaagacgccagctcctgcaca

SEQ ID NO: 34 - DNA, 429 bp, Homo sapiens
ccagaggggaggagaggaaggtgctaggccaactgcccactgcttcggaggccagaggggaggctccccgtgtggttggtagggtgagcgctcttgccaccgcggcgctgggaggaagattgccttcggggtcccctggtttaagacgccagctcctgcacacccccctcgccctctggtcccatcactgagagctttgggaccctcatctttggagcccgagtcatagggtttcgtgtctgccagcaggggtgtggagggagtgaggctggtgcccttaggttgtgtggggtggggcgtgcgctgagccctgggtctgtgtgggcagggaacggcagtgatgcaggagctgcgtccaccaccgcccgggccgagggcgactcatgggttctgaatggaaccaaagcctggatcaccaatgcctgggag

SEQ ID NO: 35 - DNA, 446 bp, Homo sapiens
tagggtttcgtgtctgccagcaggggtgtggagggagtgaggctggtgcccttaggttgtgtggggtggggcgtgcgctgagccctgggtctgtgtgggcagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaaggtgggcccacccagagaggggttcagccggatcctgggctgctgtcatttctgtttctagggccttctctccttggcccgactggacctatttttgctctggggcaagtgggctgtccctgtccctcctcagctgccactgaagcctgcaccttccccagaagccggcagagggtgtcaaggcctgagcttc

SEQ ID NO: 36 - DNA, 372 bp, Homo sapiens
acggacagagccctgcaaaacaaggtgggcccacccagagaggggttcagccggatcctgggctgctgtcatttctgtttctagggccttctctccttggcccgactggacctatttttgctctggggcaagtgggctgtccctgtccctcctcagctgccactgaagcctgcaccttccccagaagccggcagagggtgtcaaggcctgagcttctgagggaggtggggaggggaccgggttggtgttgggtgtgctggtgtgagggtgtggctgaggggcagctctgagaaaaccacccgcctctcctttcagggcatcagtgccttcctggtccccatgccaacgcctgggctcacgttggggaagaaa

SEQ ID NO: 37 - DNA, 395 bp, Homo sapiens
aggggcagctctgagaaaaccacccgcctctcctttcagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatggtgagcccggcagtgggggtggcaccttgaggccaggcccgcgccccggctggcgggccactgaccagggcggtccccacagcaaaccctggacatgggccgcatcggcatcgcctcccaggccctgggcattgcccagaccgccctcgattgtgctgtgaactacgctgagaatcgcatggcct

SEQ ID NO: 38 - DNA, 405 bp, Homo sapiens
caagatagccatggtgagcccggcagtgggggtggcaccttgaggccaggcccgcgccccggctggcgggccactgaccagggcggtccccacagcaaaccctggacatgggccgcatcggcatcgcctcccaggccctgggcattgcccagaccgccctcgattgtgctgtgaactacgctgagaatcgcatggccttcggggcgcccctcaccaagctccaggtcatccaggtaatggtggcagctttaggagctgggcctagaggctggacagcgggcggagagtgtggcctcctgactgctctccgtcctcctccccctcccttctgtcccctggaggggcagctgctgacctgtggtgtggggtggggctattgcagttcaagttggcagacatggccct

SEQ ID NO: 39 - DNA, 406 bp, Homo sapiens
cctcctgactgctctccgtcctcctccccctcccttctgtcccctggaggggcagctgctgacctgtggtgtggggtggggctattgcagttcaagttggcagacatggccctggccctggagagtgcccggctgctgacctggcgcgctgccatgctgaaggataacaagaagcctttcatcaaggtgcccacaggggtccccgagccatggcccagaatgtggtgggcccagggacggggagaggttggggcgggtctctgctccttggccccgtgggtcagaggtgtgggcctggggtttacagccccatggggaggctccacaggcctcccctgctgagggagtgggggagcaggggatggaggggtcccctcaagggaaggctctgactgtacccccatgt

SEQ ID NO: 40 - DNA, 371 bp, Homo sapiens
gaggtgtgggcctggggtttacagccccatggggaggctccacaggcctcccctgctgagggagtgggggagcaggggatggaggggtcccctcaagggaaggctctgactgtacccccatgtttaggaggcagccatggccaagctggccgcctcggaggccgcgaccgccatcagccaccaggtgagtgtccacagtgagctctgagggggccagctgccccttctccagctttccccacgccggggtcttctccctcctgagccactgttctcatctcaggccatccagatcctgggcggcatgggctacgtgacagagatgccggcagagcggcactaccgcgacgcccgcatcactgagatctacg

SEQ ID NO: 41 - DNA, 442 bp, Homo sapiens
gcaggactttgaggttgaggtgcttgcttttttgaaatcataattctctaacttgggcctgactgttacagggcctccaacaccaagtggctcacgtggccacccagctggaagctgcaagattactaacatacaatgctgctaggcttttagaagctggaaagccattcataaaagaagcgtcaatggccaaatactatgcatcagaggtaaaaaaaaaaaaaaaaaaaaaaaaggaaaaagtaattcagccttttttttttcagatatatacttattaacattttctcttgggaatgttgattgtactttggttgtttttcaagttaagataacatggacttttatttcttataatagaaaagcaaaaaaggaaaactgccataggaaaacacttgaattctgtgaggtctcaatgtttcgttgagtagcccagctcagc

SEQ ID NO: 42 - DNA, 408 bp, Homo sapiens
ccccttggaggatttcgacgtgttggtcctcagcttgaaatgtcccttagctcgtccgttaggcccccagtaaacatttcctgaataaatgatatctctcagcatgcagattcatgtgaacaatgctctaatttcttaagaaaatggggattctgtgaattaataggatgttttacagaaatggtatggagaatgggactgaagagacaatgctagtttagaagataactttagtccttccagtgccactaacagtaaatccatgttgctgaaaatgttacccagaagtgtttatcatgtataagttatgtggtttcagtgtgtgatttgcacttgcttttggtagattgcaggacaaacaacgagtaaatgtatcgagtggatggggggagtaggctacaccaaaga

SEQ ID NO: 43 - DNA, 406 bp, Homo sapiens
tggagaatgggactgaagagacaatgctagtttagaagataactttagtccttccagtgccactaacagtaaatccatgttgctgaaaatgttacccagaagtgtttatcatgtataagttatgtggtttcagtgtgtgatttgcacttgcttttggtagattgcaggacaaacaacgagtaaatgtatcgagtggatggggggagtaggctacaccaaagattaccctgtggagaaatacttccgagatgcaaagattggtaaatagattttttttttttacattttattttgttttatttgcctctgtaggtattttggctgttttatttgtcgtttttttcctaggtaaaagcaattttaatttcttcagtatatgtttggtggctctatttatgtggctgga

SEQ ID NO: 44 - DNA, 364 bp, Homo sapiens
tagcaagcgcagaggtgatgtttatagagctatttcttgtcttaaccatgcgccaactcctcattgttccttctgcttccttttgcttaaggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccact

SEQ ID NO: 45 - DNA, 374 bp, Homo sapiens
ggggcctgtttgtctctcttggggttccgtaggcagcagggggcagggattaagggggggtgtgtgcggggcgggtactgagtgggcggggccttgctcgggtaactcccaggggctggctagagacccagaggcgcagagcggagaggcctgcggcgaggatggagggcctggcagtgcggttgctgcgcggcagcaggctggtgagtgcgttcgaggctggcgtcctgggggcccagggcgaccttggcccctggaatcgcagctggcagagccttctaacgggcctcggggcgccggcctgagccccgctccacgtcctgggtccccagactctttacccgcgggcagtctatgaccccgacccccttcag

SEQ ID NO: 46 - DNA, 439 bp, Homo sapiens
tgtgagggccagtatttcccgtgctattcttgtgataatgaataagtctcatgagatctgatgtgtttatcagggtttccacttttgcttctttctcattttctgctgctgctatgtaagaagtgccttttgcctcctgccatggttcagaggccctcccagccatatggaactgtaagtccagttaaacctctttttcttcccagtcgcaggtatgtctttatccacagtgtgaaaatggactaatacagcagccaacatggtaaccccttgttcccatacaacgggtgtgtatggccccttggcagatatcaatccagtgtccacaactagggaggatttagcaaggggattttattacttgtaacaagttaaggagaacactgggattattcccacaacagtgtcttccctgagcttggggctggatcaggttttg

SEQ ID NO: 47 - DNA, 450 bp, Homo sapiens
tgcgctaggttaagtttccttattttggtgacatgaaatataagaatgggttataaagtcattcccaaagaaaatgatattcaagtacctttctttcatgtgtgtatgttccctacagctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcaggtaagtaaatttatcagtgtcacctttttctccccagacaggatctctggagcatagtggtgcaatcatggctcactgcagccccacctctgggctcaagctatcctgcttcagcctcctgaatagctggaaaaatatcaccttattattcctctggtcatgaattgggtct

SEQ ID NO: 48 - DNA, 435 bp, Homo sapiens
ttgcttgtgtttttgcaccatctacacatatcatttattttgtgaggtcatcaagagttacaaagggatatgggaaactacacctttctatgttaaaaagaaaactttataaattctattttaaaaatataagaagggtacctgtgtatattttaacttagttaaaatgtaaaattttgtcagcaaactattaatgtgactgtcactttaacatagacttatcagtaattctttttcctacagttaaaaaatttgctcaggaacaaattgcacctttggtttcaaccatggatgaaaattcgaaaatggagaaatcagtaatacaaggattatttcaacaaggggtacatttcataattcttccactttcaagcttctataattaaattcagggactgtaatgatagcataatgaaccctgcatttcccagtcaa

SEQ ID NO: 49 - DNA, 389 bp, Homo sapiens
tgttcatgcaagaaatttccccatataaaaatagctttcttaatctatgttgccttgttttttctttagttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtgagttgagatgaattgttgatctaatggatctaatctttagtaagtttacaatattttcaggaaaaaagtagctgcaatgtcgactttactatccaagaccacaatgcggt

SEQ ID NO: 50 - DNA, 421 bp, Homo sapiens
agcagctaaagatttgatttacaaatgtccatttttccataagtatttgttatacagagtataaatacagttattaatttggacatttttttctcccatatgtaggtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattgtaagtttgaaaacgaaatttctttctttttccaaaccccttcttttctctttctttatcttttcctccttctgtttcctttttaggacttcatcttgaactctttagtcttctcagtactgaaaatgtcagacttgagctggca

SEQ ID NO: 51 - DNA, 361 bp, Homo sapiens
agctgctctcgtttcataatgcccatgttgcaattctgagtccattagtatttattaccaaagtccatttttagttttctttttacttaaactcttcagaaacaaggcgttttataaatccaagtggtaatagcgttttaattcttctttttagggatataagggaattacctccttcttagtagatcgtgatactccgggccttcatatagggaaacctgaaaacaaattggggctcagagcttcttccacctgcccgttaacattcgaaaatgtcaaggtgggtatcgtagactaatcagtaaaagactgatgcgaaataagccttgcatggaaccacaggaggtgtgcaagacaggtg

SEQ ID NO: 52 - DNA, 421 bp, Homo sapiens
tctgtgagagggctagcacacgaattgagagtctatgtgtacttacaaatatataatcaaaatgaatcatggaaaatgaaactgagaaataagtgcacatttgtattttcaggttccagaagccaatatcttgggacaaattggacatggctataagtatgccatagggagtctcaatgaaggtagaataggaattgctgcacaggtaagtcagatttaaactcttccatgatgtgagtcaattaaactgtgaaaagaaaaaaatgcaatgagaccaatgaatatttggaagcttatggacacaagatggcaccgttcccttacatgagggatagaatggcttattatttctttcaaattcccttttggtcaattatgtaagtgtccatagaaccaaacaatggcttggtggtaacagtgt

SEQ ID NO: 53 - DNA, 431 bp, Homo sapiens
aacacacacctcaccacctcagcatctccagttcttcccctgccccaatcattcaatttatgtttagagggaattcacaacttggataattaaacttataacaaaataagaaattctgatcttatttttttgttttaacagatgctgggactggcgcaaggatgttttgactacactattccatatattaaagaaaggatacaatttggcaaaagactatttgattttcaggtatgtaattattagggtctttctgctgtgttagacttccccagcttcctgttaatgaagggctgtgttgaaatccatggagggaatcccttcagggggattttaatgggagatgggtaggggaggaaagaataggtctcagggagtgtacttgtgaatgccttgatctttgccaagggcagagcagtagtccttgaggc

SEQ ID NO: 54 - DNA, 450 bp, Homo sapiens
cccaccttcccacatacaccagcaggactcccttatgagccaggcttctccttaaataagtctccctcaaacagcgctgatgaacccccaaacccgccaggccccccgaaccatggaatatcctaaattttccatatccctacaggtacaaagggatcactccagggggcacctgtggccaaatcctgcattttctcagatgtgaaccccaaaactaaattaagacccccaaatacatcttacttctgatgctgccactccaggggcgccagtcccagataaggcctactaacccctccccacaaactcataccctccccccagtttatagcccccccatcatgcttaccttggttgtcactatacagagacagtccatgttggggggcctggccgcggcggcgggtaaggggctctgacttcatcggagtttcgttcctcccctccgtg

SEQ ID NO: 55 - DNA, 428 bp, Homo sapiens
ggggtgccttggcagagttaactccttctgtgctggcaggaacccggataatgggaaaggagatagaagcagaagcacagaggcccctgaggcaaacatggagacctggccagccaccagcgatgacagcaaagacgatgaggctggatttcatttcttagagaaggaagcatctatagttgggctgggagcacccacggttatttgaatacgggagggaggcctctcggcaggcggtagggggtcgggtgtgagggaggagctgaaggaggcaatccctgggggcctagttctccctcaggtttctcagggggaaacctaaaaagttaagccctagactctttagtgcctgaaactggggcagccaaagaaaacgaggaagaaagggagagtgggtacaggaccacagagagtgcattctcggtgcc

SEQ ID NO: 56 - DNA, 450 bp, Homo sapiens
gagacgagggacgcttggagatccctctaagtcagcggaacgcagggccgggctccagggaactacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgcgagcttggggcggcagctgctgaggctcgggggcggaaggtctgtgtgtgacaagagggacggtgggcagcggccctgggcaccgggccggcactgaacccccactccccacagctcgcggctcacggcgctcctggggcagccccggcccggccctgcccggcggccctatgccgggggtgccgctcaggtaagtcaccgcagccttggcaa

SEQ ID NO: 57 - DNA, 444 bp, Homo sapiens
gtgtgtgacaagagggacggtgggcagcggccctgggcaccgggccggcactgaacccccactccccacagctcgcggctcacggcgctcctggggcagccccggcccggccctgcccggcggccctatgccgggggtgccgctcaggtaagtcaccgcagccttggcaagggggtgtgggagcggcggtccgcttcggcgcccgccatcggcagggatctccctcttggtgccaggtacctgcctactgctcagtcgccgaaagtaggggaaagggcaagccagggtgccctagggcgaaactaggggaaaggtcaccgcttcgcgccgcctccccgcgcggctctcgcctgttctccccttgacacagcggaagtcccttccctgaacttgctaaccgtctcttttcccagctggctctggacaagtcagattcccacccct

SEQ ID NO: 58 - DNA, 444 bp, Homo sapiens
ctccccttgacacagcggaagtcccttccctgaacttgctaaccgtctcttttcccagctggctctggacaagtcagattcccacccctctgacgctctgaccaggaaaaaaccggccaaggcggtaggtagccccgaggccaggtggaccttagccagacccaaccagagccctgaaatttgcctctctctgcccaggaatctaagtcctttgctgtgggaatgttcaaaggccagctcaccacagatcaggtgttcccatacccgtccggtaagggaagggataatcagagctgggtggggccagggtggtttcccctgccagcctggcctgaccagcctgtcccccaccctctgcagtgctcaacgaagagcagacacagtttcttaaagagctggtggagcctgtgtcccgtttcttcgaggtaaggaatgactcggggc

SEQ ID NO: 59 - DNA, 420 bp, Homo sapiens
accctctgcagtgctcaacgaagagcagacacagtttcttaaagagctggtggagcctgtgtcccgtttcttcgaggtaaggaatgactcggggcttggtccctggtgaggtgtttggagatgttaagctcaaaaggagcctggatgtgggatcctgtgccttccccaggaagtgaacgatcccgccaagaatgacgctctggagatggtggaggagaccacttggcagggcctcaaggagctgggggcctttggtctgcaagtgcccagtgagctgggtggtgtgggcctttgcaacacccaggtgagggcgccctatcgccacatcccagtatgccataccccagcttggcagactcagctcttttgccatagacctagagactagggctaaggtctcttctaagcacctgccctggg

SEQ ID NO: 60 - DNA, 443 bp, Homo sapiens
gccctttgcacaccccacttcttttctacacactggggatggcccaggtcaggcactgccctaggtcaggaactgccctaggtcaggaactgccctgttgcccacactctcctgttaaggtcaggtccccctgcagccagtgacaaccccagattcctgcttcccctccagtacgcccgtttggtggagatcgtgggcatgcatgaccttggcgtgggcattaccctgggggcccatcagagcatcggtttcaaaggcatcctgctctttggcacaaaggcccagaaagaaaaatacctccccaagctggcatctggtgaggcaaccctaggagagccagggattggggggcacactgggcttggcacagattaggccagttggcacttagattatcagatggctgagcatttcagttgggggaaggttttggggaggcatca

SEQ ID NO: 61 - DNA, 396 bp, Homo sapiens
gccgaggggactttgaagctcatcagaacttggggtaaagtagctctctccccaacaggggagactgtggccgctttctgtctaaccgagccctcaagcgggtcagatgcagcctccatccgaacctctgctgtgcccagcccctgtggaaaatactataccctcaatggaagcaagctttggatcaggcaacctgcctcccatttctccccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcg

SEQ ID NO: 62 - DNA, 413 bp, Homo sapiens
ccttctcctccgcccaattccaggccccactgctccccgtcctccacgccctgaatatcccattcttccacagtaatgggggcctagcagacatcttcacggtctttgccaagacaccagttacagatccagccacaggagccgtgaaggagaagatcacagcttttgtggtggagaggggcttcgggggcattacccagtgagtgaatttgggttgggggagcttaggactgaggggcaggactgggctcctgggcagatggctgttgcaagtcaccctggggacgtgtgcaaaagccaaagcaggtggactgaatgtggcctttgggactaatatgtatgcaactgagctaaagttttggctccagcaaccaagtccaacacaaaataggacatagccaggcctccttagc

SEQ ID NO: 63 - DNA, 417 bp, Homo sapiens
tggtgcataaggagcgaaggagcagtttttcccccagtgacaacctgttgaacacacctctgctttcccacactgccctgacacagtgggccccctgagaagaagatgggcatcaaggcttcaaacacagcagaggtgttctttgatggagtacgggtgccatcggagaacgtgctgggtgaggttgggagtggcttcaaggttgccatgcacatcctcaacaatggaaggtttggcatggctgcggccctggcaggtaccatgagaggcatcattgctaaggcggtgagtaccctgcccgagtccctaggtaacccaaacagaagtctcactgtcccccttgccatgtgtccctgatcacttgcaggcactccctacactagaaactcctcccctaccagcagcccgacttgctag

SEQ ID NO: 64 - DNA, 441 bp, Homo sapiens
gaagtctcactgtcccccttgccatgtgtccctgatcacttgcaggcactccctacactagaaactcctcccctaccagcagcccgacttgctagcttaggtctccatccagcgtagactgaactctggttgtatgcaaaacccatccctctggcgcaagcccagcccctctcctagggagactgcagaaccacactgaaccacagcgggatgtgtggaccctcttccaggtagatcatgccactaatcgtacccagtttggggagaaaattcacaactttgggctgatccaggagaagctggcacggatggttatgctgcagtatgtaactgaggtgagggcctcccaagcccctctccctggagccctggggctttcttcccagtcgggtcagactacaacccccagcagcacctggggcagtgggtctccagctttac

SEQ ID NO: 65 - DNA, 449 bp, Homo sapiens
agtcagctcagcttctgcgaagagagacagcaatgatgttctgctcaggtgcctgccagcagtaccagaagttaattctacctcatcccttacatccaccccttttaagaaaacaaatacctggaagcacctgatgaactgacccagaacaagtatctgcctgacctgacaagctaggtcagcccttatcttggagatctgggtgatgaggccaagtctgacaaagccctttgcaattttccttcccatgtcccaactatgcaacctcagtccatggcttacatggtgagtgctaacatggaccagggagccacggacttccagatagaggccgccatcagcaaaatctttggctcggtgaggtcccaggcatgctgggagggagtccagtttgggtgctcagctcccaaaaccagtctcatctgttctttgtccctaggaggcagcct

SEQ ID NO: 66 - DNA, 433 bp, Homo sapiens
gggagtccagtttgggtgctcagctcccaaaaccagtctcatctgttctttgtccctaggaggcagcctggaaggtgacagatgaatgcatccaaatcatggggggtatgggcttcatgaaggtacaggacggtcttctgcagagcctcggctgggccaggggtgggtaggcacatctcagcacgggcatataatttgtgtggccctgtgctaggaacctggagtagagcgtgtgctccgagatcttcgcatcttccggatctttgaggggacaaatgacattcttcggctgtttgtggctctgcagggctgtatggtaagacagagaattgggtgggggtagaggtggggaggacagtgagtcctgactgctggaccctcttcccccataggacaaaggaaaggagctctctgggcttggcagtgctctaaa

SEQ ID NO: 67 - DNA, 450 bp, Homo sapiens
ccctcttcccccataggacaaaggaaaggagctctctgggcttggcagtgctctaaagaatccctttgggaatgctggcctcctgctaggagaggcaggcaaacagctgaggcggtaggcttagggccagagccaggggagggcagggtggtgtatggcaactaaccagtcattctccctcttcctctcaggcgggcagggctgggcagcggcctgagtctcagcggacttgtccacccggagttgagtcggagtggcgagctggtaagtggccaggggtccaggagagcctgcatcagggactgcagccgatggcccctctgagccccgcactgtccccatctcttaaggcagtacgggctctggagcagtttgccactgtggtggaggccaagctgataaaacacaagaaggggattgtcagtaagtgagctctacaccattccgccc

SEQ ID NO: 68 - DNA, 445 bp, Homo sapiens
ctgtggtggaggccaagctgataaaacacaagaaggggattgtcagtaagtgagctctacaccattccgcccctccctttcctctccttgagactaatgcccccacccccacccccaccccacctaccggacagatgaacagtttctgctgcagcggctggcagacggggccatcgacctctatgccatggtggtggttctctcgaggtgaggaggcaggcagggaatgcctgagccgcagggggcctgggcctggatcccagccggcccagatttattttcatctcctgcttcctgccagggcctcaagatccctgagtgagggccaccccacggcccagcatgagaaaatgctctgtgacacctggtgtatcgaggtgagactcggggctgccaagctcaggtgagggctggaggtgcaggcccaacccctccttccctctcc

SEQ ID NO: 69 - DNA, 356 bp, Homo sapiens
tccagtgccatcatgcatgtttgtgatgtttgagaaaactgttttatgtacacaaaaaggcattcttacattgtcttgcagttagctgtgtacatgtttcctgagggcaggaattgtctccacccatatttgtaatttctttaaacatttagcagcccaggcaataggtatttgttgaattgaaccaaatacatttattgtgaaggaatgttttgacttcaacctcatttttgctttcaggcacagtaacagctgccaatgccagtacactgaatgatggagcagctgctctggttctcatgacggcagatgcagcgaagaggctcaatgttacaccactggcaagaatagtaggt

SEQ ID NO: 70 - DNA, 449 bp, Homo sapiens
gcagatgcagcgaagaggctcaatgttacaccactggcaagaatagtaggtaaggccaggcgaggtggctcacacctgtaatcccagcactttcggaggttgaggtgggaggattgcttgagccccggagttcgaaatcagcctgggcaatatagtgagacttcgtctctacaaaaagttaaaaaattagctgagcatggtggcatgtgcctgtactaccatctactcgggaagctgaggtgggaggatgccttgagcccaggagtttgaggttgcagtgaactgagattgtaccactgcactccagcctgggtgacagagcgagaccctgtcttaaaaaaaaataaggtttctaaacatctataagctcttcatgaaattgagtttacttgttagatatagccaactccaatattaagtattactacctaggttgtacttgtggcaga

SEQ ID NO: 71 - DNA, 401 bp, Homo sapiens
acctcagcactattgacttttgcactaagtaattctttgttgtagggactgttctatgcattgtagatgtttagcagaatccttagtctttacccagtggcatctgaactattctgacaaccaaaaacatctctaggtggtgccaatgttcctagaggcaaatacccccaaactcccccccaatgaaaatcagtgtcttagattactggagtaattttataaagtgtagaatcctagaaaaggaagacatatatttacatatattaaaggggctaggaaatgtgcatttaatgggctaaacttggcttgtgcatattctatacagtaaaaaaaaaaagattttaacaacccccccccccctttttttaaacagcatttgctgacgctgctgtagaacctat

SEQ ID NO: 72 - DNA, 450 bp, Homo sapiens
atgggctaaacttggcttgtgcatattctatacagtaaaaaaaaaaagattttaacaacccccccccccctttttttaaacagcatttgctgacgctgctgtagaacctattgattttccaattgctcctgtatatgctgcatctatggtgagaacaaagtgaggggcgatactccattatgctagcttctggtttgcttataccaaggttgcagtttttaagattttaaatgttatctgccaaagcagagagatagcttggtttcaaatcttcccatgtcttctcctgaaaagagtaagagcaacaaggataacaaacaaaaaaaaaaaaataaagaacagctcacaaactacatcttcagtagaacaggtaaaactacacatctgaattacttgtaagtatcatacagaactcacacacctggtgtggtaaccacaaagcggagggaa

SEQ ID NO: 73 - DNA, 350 bp, Homo sapiens
tagagatccttccatctgaaaccaagaacttccatatttaaataacttatgtcaaactgtagtatttcaaggaaatgatgacagtaagttgtgattgctaattatttgaacatcatctgtcttttaaaaaatttaaggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggtaggtaaaaataataactatatctaggttaagagctgcctttgtgtttctagct

SEQ ID NO: 74 - DNA, 448 bp, Homo sapiens
acccttcctgaaacaagtcctccaagttttagttttagaatagtagtagttaattcagcaagtagtagtggctagtaaggttttcaagaagttaaattggaatagaaacattttggttagtcataaattctgtacttcattaaagaagtaaatgctttcttaattttaggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaaca

SEQ ID NO: 75 - DNA, 432 bp, Homo sapiens
tcactcgtcaacctttcctggcccaggctgcggtgtcccagcgccaggctccgccccgcccttggctgccggccaatcgccgccgactgagaggcgactattggaggaagcgggatgggcggtgcccgcgccgggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggtgagcggggttcgtccccacagcactcagacccgggatgcgaggagtccccgcctcggaagcttccagcccgcggccgttgcggctcccgcggcccgggcgcgcggcttaggccccaggacagtcacgcgacgggttctggtccaaaaac

SEQ ID NO: 76 - DNA, 404 bp, Homo sapiens
taaggatgcaggaagaaaccactataaccttatcactgagaaatataaaatgatatagtttaatattttttacattataacattataaatatttatattacaggaaataagatatgtggaacggagttatgtatcaaaacccactttgaaggtaagtaatttaaattgtgctttaaaatttccagaatttaaaggaaatgtcaataaaaatgcatatacttatgatttggatacatgtgaaagtcaaagcaggattatgtaacagttaggaatagctaactattcaaatattcagttaaagtagatgactataatagaaaaacatgtcagttagtctctgccaatgtttgttgcttccttatagtctgctacaaaacaacattccctctagaactgggcagtgt

SEQ ID NO: 77 - DNA, 404 bp, Homo sapiens
agcttctgtcctcaaacctcctgtagagaactgggaaggatctacatctgttttagagttggtttctataaggtcttaaatcataaagcactagcattgaactgattatcttgacagctgttcaactattgagattaatttttgatgactcattcatagaagtgtttttttgataatatatttatgtttatttaatgaaatacgatttgggtaaaatacctataatttttaccatcttgtgtcttgccaggaagtggtcatagtaagtgctacaagaacacccattggatcttttttaggcagcctttccttgctgccagccactaagcttggttccattgcaattcagggagccattgaaaaggcaggtcagtagttacttggctttttgtgttaagggagca

SEQ ID NO: 78 - DNA, 403 bp, Homo sapiens
accattcctattgtgtaatgtcacctaccttattaggtaatcactgattattaaattgaattaaatgcctttttgactttttttttttttaataaagggattccaaaagaagaagtgaaagaagcatacatgggtaatgttctacaaggaggtgaaggacaagctcctacaaggcaggcagtattgggtgcaggtacctggaagacttttttgcttttatacttaaaatgtgtaaaaggggccgggtgcggtggctcatgcctgtaatcccagcactttgggaggccgaggcaggcggatcacgaggtcaagagatggagaccatcctggccaacatggtgaaaccccgtctctactaaaaatacaaaaattagccaggtgtggtggtgcactaatcccagct

SEQ ID NO: 79 - DNA, 350 bp, Homo sapiens
gttctgcagttgtgtttgagtatcggtttttcaaaagtgacttatattggttttaggcttacctatttctactccatgtaccaccataaacaaagtttgtgcttcaggaatgaaagccatcatgatggcctctcaaagtcttatgtgtggacatcaggtaagaaacaccgtccttcccatttattaatcagagtaatacctagggctaaaagacacaaaaatctaggcatattcatattttagaaatgagattctttctcataagttagtatgttttctcacatgctcaagagtgtctggatttgctaagtccatttgaagtatggtcaaaatgatagcgtaggctgggt

SEQ ID NO: 80 - DNA, 419 bp, Homo sapiens
gctttctaattagccttgctgatctatatcttgtctttacttgagatcaagcaagagacaggctccttagcaaaaatatgctgtcatgtcaggaggtgagacctggacacacagaagaatcaagattctctcagatctgagcccttcatttttcagatgaagatttttttcagtgtgtctgagacagccacagagttacagggctgagcatctgccatgtgacagtcattggaaatagagtggtgaacaaaacatttaaaaaaatctgtacatgtgcaggtctctgttggaaaaatgcctaaaagaaatgctgagtcaggatttgaacattttggtatttgcaaatgctttccataaaagttgtaccagttagactttccaaaaattgtgtgacttgtctggatctgcaccaccactgg

SEQ ID NO: 81 - DNA, 377 bp, Homo sapiens
atgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatggtaaatgtgatttttagtggataaatgctatctaatgtccaatactgtttgatttttcttactctatgtactttacaaactgaactgaaagatgggctctataaatgttgattttagccgtgtacttttggagaatatttttgtatgcctattgcatcggcatggctcagtcattaaagaaattttcccacatttaaatagggtaatttctgacgcttagctggcaactgcttg

SEQ ID NO: 82 - DNA, 374 bp, Homo sapiens
aaacactataagttaggcaaagttaatagatattttctaaattatgcaaagttaactttaaaatatttcaactttttatcagggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtagagataatgttccaaaaaggatgaatagacttttcatgttgctgaatgttttatgcttaagttttaaattaggacattatcttggttcatttcaactgcttatggttaataaaaagtgaagagttgccagttcagaga

SEQ ID NO: 83 - DNA, 445 bp, Homo sapiens
agggaggcacagactactaggcatcttgtacaacagttgcttgctgaatgactacttgttttgagcgattttacttaaaatatttttattttaggtcaaccagatgtagtggtgaaagaagatgaagaatataaacgtgttgattttagcaaagttccaaagctgaagacagttttccagaaagaaaatggttagtgttaagaaatgaagcataagaaaaaattgagccagtataccatatctagttcttagaattgcctaaggattttgaaaaattctagaaaacatctagatgttatttaacattttcagtatatcaggctcatgtaaaattgttttggtagtttataccttcaatatataaatcccagggaagatatgtataacatgactatagaattcagtttttcatatgtagcagtctatgatagggtcttcattggca

SEQ ID NO: 84 - DNA, 449 bp, Homo sapiens
tctacgcctgtggagccgatactcagccctctgcgaccatggctgtgctggcggcacttctgcgcagcggcgcccgcagccgcagccccctgctccggaggctggtgcaggtgagcggggttcgtccccacagcactcagacccgggatgcgaggagtccccgcctcggaagcttccagcccgcggccgttgcggctcccgcggcccgggcgcgcggcttaggccccaggacagtcacgcgacgggttctggtccaaaaaccgcctaagtgctccgataacacccagggactcgcctatttttacagcgcgtttctacttccaaggtctcggcgtaatcatcttaatgagcgttactggtgtgtcaaacaagggcacgtgtctgggcgggcaggaccgccaggattggcgctggcccggcctgagcggtgggatcggggagagtctctt

SEQ ID NO: 85 - DNA, 449 bp, Homo sapiens
cgaaacctcgcctcaggcatgcgggctctgacgggcaggatggcggcacggagggctgctgtatccagtgaagtcagcagttcagatgaaacagataactcccttaaaagacacaaattgccaagactgacgcaaacactgaaacagactgaacagttctgagttaccaatttaaaactgcaaagcaaatagcaggcccaaaaggcttcactgataaattatctcaaacattgaaggcaaaaaataaaaccagacacagcaaagtaagtctctgatgaaacagagtggggaggaacacttcctaactccccgtatgggaccagcactaccctgaaatcaaaaccagacaagaaaacgagaggacagtgttcccaatgggcagacacacaaaatcctaaacaaaacgttagcaaattaaatccagttaatgcacaaaaagacaacacgtc

SEQ ID NO: 86 - DNA, 386 bp, Homo sapiens
ctgtccaggccacttgctgtacctggcccacagctacctcccctgcagccctgagtcctgcttgctgtgcccggctcaggctgagactgcagtgcttgtccattcaccatgaaagaaagaagaacaggaagggaggcaggaggaagtaagttagaggattaatccaaatgttccaactgtctaatgggagttccaacaagaagatatccagggaggaaattcacagtcaaatttccccaaaccaaaggtcatgagttttcaggttgaaagaacacccaaccaagaggagagaaaacagcattctaaatatcggaaggaaacgaaacctcgcctcaggcatgcgggctctgacgggcaggatggcggcacggagggctgctgtatcc

SEQ ID NO: 87 - DNA, 382 bp, Homo sapiens
tctgtgcaggcctatcctcaggtgtgccctcgcccaaggcctgcacgcaccatggcttctgtggtaccagtgataacaccatgccgggcacctcctgcagtcaccacccctgggctgctagggcagagacagctgcggtggcccggtgcacctgcctggcctcaggatggccgaggcgcctggcaaggctgcagggtcccaggggcacctgtccgtactgctgggcgcctgagttcctcctgctgggcactgtcagggcagtgcgcctcaggctgtgcttgtctctgcagaaatgtcctggccccgtacgcggtgccctcggagctggtgctggtggaggagatcccgcggaaccagatgggcaagattgacaagaaggcgc

SEQ ID NO: 88 - DNA, 356 bp, Homo sapiens
ctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtca

SEQ ID NO: 89 - DNA, 440 bp, Homo sapiens
gctgggtactggggaggtgttttaaatcctgtcttggccacgtttggatgggacagttgggcactcacgtcctgtgccttgcctttctccagctcggccgcctgtcagtgcaatgctgccccatgtggtgctcaccttccggcgcctgggctgcgccttggcgtcctgccggctggcgcctgcgagacacagaggaagtggtcttctgcacacagccccagtggcccgctcggacaggagcgccccggtgttcacccgtgccctggcctttggggacagaatcgccctggttgaccagcacggccgccacacgtacagggagctttattcccgcagccttcgcctgtcccaggagatctgcaggctctgcgggtgtgtcggcggggacctccgggaggagagggtctccttcctatgcgctaacgatgcctcctacgtcg

SEQ ID NO: 90 - DNA, 449 bp, Homo sapiens
caggctctgcgggtgtgtcggcggggacctccgggaggagagggtctccttcctatgcgctaacgatgcctcctacgtcgtggcccagtgggcgtcatggatgagtggcggtgtggcagtccccctctacaggaagcatcccgcggcccagctggagtatgtcatctgcgactcccagagctctgtggtccttgccagccaggagtacctggagctcctgagcccggtggtcaggaagctgggggtcccgctgctgccgctcacaccagccatctacactggagcagtagaggaaccggcagaggtcccggtcccagagcagggatggaggaacaagggcgccatgatcatctacaccagtgggaccacggggaggcccaagggcgtgctgagcacgcaccaaaacatcagggctgtggtgagtgccgcctggcgccgtgatggtttcg

SEQ ID NO: 91 - DNA, 417 bp, Homo sapiens
tccccagggtaagtgagtgacccagcagatctgctgtggttttgtcgtcatcttgagaggctgctaaaggggagcaacaaagagccagccttctccttccccttcctcagtggggaggcccagagctcctttccgtgagcccgaggtctgtgtgtgctgttgcgggccacagtcttgctcttgctctcagctgtgctctcgtcccctgcaggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtgagttggggtcagggctctcggttgcaccctcagactaggcgcctttc

SEQ ID NO: 92 - DNA, 414 bp, Homo sapiens
gggaaggggtcagagtttgaggcaccccttttagaagggaggcgctgcagactcttgaatgtgaaccatgagaacgctgtgcctggagccaggagcctccgccacgggccccagtgcctgctcatcttcctaccgagtgcttcctttccttcgtaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggtaagtgaaaagagcccactttctcgttcagaaagtcttaaagatcaacagatacgacttatttctaataaatcactcctactaagttctgggaagcagtgct

SEQ ID NO: 93 - DNA, 419 bp, Homo sapiens
ggagctgccacttttgcaagcaagggccgcctcctgaggggctaaacctgccacctttgcacgcgagagccacgtcccaaggggctaaacctgcctttggttgtgccgcgtaggctgatggtctcaggctcagctgccctgcccctcccagtgctggagaagtggaagaacatcacgggccacaccctgctggagcggtatggcatgaccgagatcggcatggctctgtccgggcccctgaccactgccgtgcgcctgccaggtacgagcacttcccacagctgcgttcctcttccactgtgctctgagccccccaaggtgggccagtctcgaaccacccacattcggactgaagggcggcatggaggatgctcccccgtgggacaggccactcggccaggagagcactcaggatgcac

SEQ ID NO: 94 - DNA, 419 bp, Homo sapiens
ggatccgagctcagtgtgtgcttctctcctccaggttcctctcactccagcctccccttcagtgtttctcctctcctgtaggttccgtggggaccccactgcctggagtacaggtgcgcattgtctcagaaaacccacagagggaagcctgctcctacaccatccacgcagagggagacgagagggggaccaaggtaagccactctgctcttggcaggtgggcggccgtgtgtccagtctaggccccccagggtggttacactggtgcatctttcccctggaggcagactcccctccacgcaggggaccagccccctggacactgcaggtgctggctggtgttgcaagggcactggctggtgttctgggccctgcctgctgcgtgtccgtctgtgcgttcacagagcagtgggcagagg

SEQ ID NO: 95 - DNA, 390 bp, Homo sapiens
cccttgctatacccacctcccctgccctctgtagggccccagcccatgctgttgtcctgacatgcctctcctgggattcctgcctctgccctgctggtactaggctgctggccacaccccacatctcaggttcctgaatacaccggcccttcctggctctcaagtctgtgccctgcagtgcccctgcccccaactcgaggacctcccagctcagccagttccaaccctgtctgcagggacggggctcagcctgtgcctgggttggggacaccatctagtcagaaatgtccccagcagagagcagaacgtgagtggcgtgtggaggagtgagacgccccgtggctgtgcagccctctccaggtgtcagtcagctgacactcctgcctctga

SEQ ID NO: 96 - DNA, 397 bp, Homo sapiens
tgcttagctcagcatggttggcttccacctgtcaaagctgcgttttccaagcattccaacaaagcgctcagtttcagaaagcacgcggccctgggtgggccctgggtgggcagggagcagcccacagtttcagaaagcaccaatcccaagagggtgtgcccagctctgacctccatgttcttcatcctccacaggtgaccccagggtttgaagaaaaggagggggagctgctggtgaggggaccctccgtgtttcgagaatactggaataaaccagaagaaactaagagtgcattcaccctggatggctggtttaagacaggtaggacccagccccatgggagtggaggagaccccgaggggacaggcaggaactcattgctgcccacgttgagtga

SEQ ID NO: 97 - DNA, 391 bp, Homo sapiens
cacgtcgtgaccaccaggaatgtgggcttacctggcatagctgtttctccgttggggttgccacagggtagtaaccagagccccctttcctcagaggacaccgtggtgtttaaggacggccagttaaccagagccccttttcctcaggggacaccgtggtgtttaaggatggccagttaaccagagccccttttcctcaggggacaccgtggtgtttaaggatggccagtactggatccgaggccggacctcagtggacatcatcaagactggaggctacaaggtcagcgccctggaggtggagtggcacctgctggcccaccccagcatcacaggtgcgtggccggacttgggccagggaggccaggctagacgggtgctgccttccatg

SEQ ID NO: 98 - DNA, 360 bp, Homo sapiens
cagactgcgctcttcctgtgtgtccaggcactcttcggcctgtaagggtcactgaggcatccccatgttctcaaactgttcttctatccgcagatgtggctgtgattggagttccggatatgacatggggccagcgggtcactgctgtggtgaccctccgagaaggacactcactgtcccacagggagctcaaagagtgggccaggtagggctgggtggggcgggcagggagcactcatggggtcttgggggtccagtcttgagggccaccctaggtattggcatcgtccgtcttagaggtggagatgagggatcaagaaagaccagcagtgagggtccttagagacctgaaggccgcac

SEQ ID NO: 99 - DNA, 433 bp, Homo sapiens
ctctgtcgacctggtgtctgcagagccactccccgaccttctaaattccctaaagcctctggctgtgtgtggcgctgtcctctgtccccagggtaagtgagtgacccagcagatctgctgtggttttgtcgtcatcttgagaggctgctaaaggggagcaacaaagagccagccttctccttccccttcctcagtggggaggcccagagctcctttccgtgagcccgaggtctgtgtgtgctgttgcgggccacagtcttgctcttgctctcagctgtgctctcgtcccctgcaggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcct

SEQ ID NO: 100 - DNA, 398 bp, Homo sapiens
ggggcatgctgggacttgtagtccacggccacccggaacggcccgctcatggccgcgcgagaactccaacttccagctggcttcgcgcggccagaaacgcgccgaggctgcgattccagggggtccagagagccccgagtcggccctgcagcccccgccacgaacaagccccgggcgggtgccgggcggccgcaaccggctgcaggtcctgggactcaccgactttgtagggcagtttgtcagacatgctggcggcactcgtgatggaaacgggcgaagggggctgggcctcagtctgggaacaggaactgggcgggcagcgccgagcagggatatgcgcgtggcgccgacgcctttaaatatcttcctcgcacttgcatattcatgacccgctgggg

SEQ ID NO: 101 - DNA, 445 bp, Homo sapiens
ccaacagtgaccttcccagccagggagaaaatctgcagaacactcaccacaaggggtggcagcactgggaaacggaggaaaccgagtgagagggaggaacccctccaggcccgcggtcagctccacacctggaaggtccccaccctggcacagtcgtcttcttccctggctgaacccagggagggcaaggactctggggtgatacagctgtgggcctcacctcagcacccagggtgacgagggtctcaatgaggacggccgtctccacggtcatgtgcaggcagccagcgatgcgggcgcccttcagtggcttggaggccgagtaccgctcccgcatacgcatcaggcccggcatctcgttctcagcaatgtccagggccttgcgtccccaggcagccaggccgatgtcggctacgggaggaaacaggtgggagttccgtgagtc

SEQ ID NO: 102 - DNA, 447 bp, Homo sapiens
ccgtagccctccccagttctttggaaagagatccacatccttcctttaatgaacttcccctccgcttcatcatgtagttcccaatcataagatcttgctcttcctggttacacggcttgacctgggtcaataaacaacttccacaggattttagatgatgatgggacaaagcagctctttcctgtggggtcgctgggctaggattttgtggcggtgactcctctccctttctgatatgtaaggaagtctgttgctctagcagtcagtgaagcaaagagggcagaatcccttcacaaattccacgtctcagaagcaagcaggacttacccggaatgccagccttggcaatggcagccgccgcatggtcctgggtggagaagatgttgcagctggaccactgcacctagaagagccatcaaaacaaggctgttggtcactgatggctca

SEQ ID NO: 103 - DNA, 400 bp, Homo sapiens
tagcctcgcaccctcagaagtcaggaggccccagcatgaatgccagagcctgccatcctcccatcttccagatcctgctgcttgaggtgatgggagtcctgccaggcctgcggccatcatgtgggcaaacaggccccacccaggccaccagcacccagcccacctgccccgccctgctcacctggcagaagctgcgggtacttggtgtggatgaggttggtgaggtcgcccccgtcgtccagaatcatgttgaggggcccgtccttgaagtacagggtctgctcaatgcaccacaggtactcctcgtccgtttcgcccttccaggcatacactggagggtgagtggcacatcagggcctggacttcccaactggtacctgctccagggaacaactctggc

SEQ ID NO: 104 - DNA, 389 bp, Homo sapiens
gtcctgagctgcagccactgtagcgggagctgtcactgcccctcggctcaccttggtgacggagtcattgacattgatggcaggcaccttgaggatcccattggccatcatcttgtagaggttgtggaccccagtcgtggtctcctcagagatgcctcggatgcctaaacaagaggggacaggacaagcctcagagatgccacacctgtgctcatgcaaattcctcatctttaccccctaaagccattcctctttctgggttcccatctctgtgactgatcccacaggccccccaatcacccagacccgcgtgagggaggagtccccaacgccctcctacagggaagccaccaccaggcctagtgactctgcctccgaacaactcccag

SEQ ID NO: 105 - DNA, 375 bp, Homo sapiens
gacaggcctcatccatggtggtcacctcatagcctgtgcagagacagtggctgtgggtcatctacggtggccttgcccctccctctggccccagtggctgacaaccaacccttgccctatcctaccctccatggcagcctgcagtgcgttgatggggtcaatctcggtgatgatgacgcgggctccgaaaccccgcagggcctgggcacagcccttgcccacatcaccatagcctgctaccaccgctaccttgccggcaatcatcacatctgtggcccgcttgatgccatctatgagggactcccggcagccatagaggttgtcaaacttgctctgaaaggaaagggggtaaggagacaataggggcaggcaagg

SEQ ID NO: 106 - DNA, 398 bp, Homo sapiens
cagcactcctctgcactcccatctgcccagcccactggcaaggcgggagcttctcacctgcggcttgatgttcaccttctccacggcgttctcgttgagccacttgacatcgatctccacgtcaaagtgtccaatgttacacacaatggcatcatccttcatctgctcaaagtgcctgtcaggcagcccaagaccgtgggagattgtcagggacagaaagctgtcccaactctgccctcctccctcactccccgggaccccccatctggcacctaccggccaaggatgatgtcaatacagcctgtggtggtgacaaagatgttgccctcctgacaggcctcatccatggtggtcacctcatagcctgtgcagagacagtggctgtgggtcatctacgg

SEQ ID NO: 107 - DNA, 403 bp, Homo sapiens
taagagggcagacaggcaagcactttataaactctggcaagccctgtgtggggatcccaggattagacacgtgacccttggcttgaggtagaagaataaacccaccttcttgggcaggaaatgaaccccaacggggtacttgtctggatgggtccacagctcgatctgcgccatcacctggttggtgaaggagttactcatcacgaagctggggtggcccatggcacaacccaggttgaccagccgaccctcggccagcaggatgatgcggcgcccattcttcaaccgataccggtccacctacacgcaggcagggcaacagtgaaggcaggcagggccccgctcccacagcccaccctctgatctggcaggcctctctgcctccaacagtgcccatgaggag

SEQ ID NO: 108 - DNA, 423 bp, Homo sapiens
gtggctgggacctccatcatgaccggggcttgaagagggtactctgttcccgctgccacatttggaacagtatgacggctgcagcagaggccaaaaactaagtgatcagccccagagagtcgatgggggacactgacaaaccaatcacaaagttggtgccattagctcttagggaggagaggtggggcctgggcaaggacagcagctggagggtgaaacgcagacctggctctcagtagcggtagtgatccggcttgaaggggccatcacaggacatgcccaggtactgggcttgcttctcagttagcttggtcaacttcacattcagcttgcccaggtgggcttcagccactgcctcatccagctggggagaaacaaaggaagaccgggaatcagtgccattttctgggacccctacacgcg

SEQ ID NO: 109 - DNA, 424 bp, Homo sapiens
cagacgggccaccacacttacagccctctgcatcgtcgcctgcaacgagtgcagacggcgcacagaggccaccacactgccaggcacgccgggagatgtagtccaggcctctgctcggacaggtctctctccggagcaaaggatctgaagggggcgtgggcagccccaagggcaggctgggatttagagcagagaatgcaggaacccgcaaccacagggaagaagcctccagctctttcggctgactcttcagggcagctcgggcaatccagagctgattgggctgcccagaacaaagctaggggctagaccgccccctgcagaaccgccctgtctccagagggtcaaagttctggaaagggctgaaaggtctgaatcatacctttaggacctcaagagagtaaggtcaagtgggggtggggaa

SEQ ID NO: 110 - DNA, 436 bp, Homo sapiens
cctggctcacctgcagcatatgagacacgtcaaagagcgagcagtgctggcgtgtgtgcaggtgcgagtcagtgtgactgtcccggtactgcactggcagactccaacccgcaaacgccaccattttcccgccgtgggccaggtggaagtcatagagcggtgtcctgcggagcacctcctgtgggcggctgggcttagtgccaccagggccctagcccccagccgcttccctcccccaccctccaagatcagcaccctctatcccacctgtgcgcaactaagtggacgacacaaggccggggggaatgcctgcaggcgaaagcccagacgggccaccacacttacagccctctgcatcgtcgcctgcaacgagtgcagacggcgcacagaggccaccacactgccaggcacgccgggagatgtagtccaggcctct

SEQ ID NO: 111 - DNA, 416 bp, Homo sapiens
agggaactggacaggacctagcaccttcctgaaataaccccttttcaaaccaacatccagcccaatacatgagagtgggtgtcagccctggaaaacccgggacattaaggcacaccatttaatgggggcaagctagaaggatgagatgatgagaccctctgagctcatttccttggggccattgacctatccatgacacccccatgacctctagctcttctgagaaggctgtccttggaatccagttcacagcaaacaaagccaaggagtggaccactgtaaacagggaggaaggcctgatcagatggccagtgtgctcccctggctcacctgcagcatatgagacacgtcaaagagcgagcagtgctggcgtgtgtgcaggtgcgagtcagtgtgactgtcccggtactgcactg

SEQ ID NO: 112 - DNA, 438 bp, Homo sapiens
agcccatttgctggctcatgactaagaaaactcatagagcagaaataaaagggcccacctggtttggtcttagctctgcaatgtctccaaccactagactctccatcagcttcacccggtcactaccaagtatcttggtctggggaagagattgaaagcctcaggccattgcaacagctacaatccaaaaggctactaagcaaggatgcatcctccctgccatccacagtgcagtccagcccacccaaagtgactaaccagtcttttggttctacacgtggcaaaggaccaccttctgatttcctgacctcccccagtcactctgtgtggggggactgccagggaactggacaggacctagcaccttcctgaaataaccccttttcaaaccaacatccagcccaatacatgagagtgggtgtcagccctggaaaaccc

SEQ ID NO: 113 - DNA, 449 bp, Homo sapiens
ggtaatcccccaccaccaaaccctggcgtgctccagagagggcctgctcttgagtctcatagctgttcattcactgaaagagccattttccaggtcccttgtctgtgccaaccctgtcttggacaacaaggatactgctctatgaacaaggaagacaaggtgtctagaacacagagggggtatacctgcatgagggccaaatctttctcccagcagccagcgttggacaccacatacaggtggccctcagaagtattggttacaatcaagtcatctaagatgcctccagcctcgttggtaaacagcgacagtgtcccctaggaccaaagtggagcgttttggcttccaggtccaggagggcaaggccaagggtgagccagacacaaccctggacccacttagttaccaaaaggttatgaaccctaatgtgaaggactcagggtgtgcaa

SEQ ID NO: 114 - DNA, 448 bp, Homo sapiens
tggcctctgtgctaagcagtcaatgaagccaggaaggcaaaggttggctccaaccccagcccagccctctcaccttgcagagctagcagggcattatccaacacctccaggcccacatctctgccctggttctgaagctccctgaccttgtcctaaaagacagaaacacaagagcatctggggccacttactgagcagctaccatgggctggacgctgcagagctggacagtagtaggacagtggagaggaggaggaggagggaggaaaaaaaaaggtagtaggctggttcccatcttacaaggtcacatagctactaagtgatagagatgacccaagcccagttctgccacctcacaccagaggggccaagaccccctccccatgcctggtaatcccccaccaccaaaccctggcgtgctccagagagggcctgctcttgagtctca

SEQ ID NO: 115 - DNA, 425 bp, Homo sapiens
cagccagacacgccaaacacctccatcacagcactggtcatgaagggcagtttcctcaggtcatctgccacgccggcctgtagtacctgggctgcagtggggcctgggcccagggagccagtgaccaagtatccaggtcccagcatccctcaaagctggactaaagccttattcagggaccagaacaagccctgagcatgtcttactctgcaagtgggagaagatgcccttgtccctagcccatggagccttgtggtaggtaggaggagggcaagatacaaaacttaaaattatggcacacaaatatcacaccttccacacattcttcttggtatggcctctgtgctaagcagtcaatgaagccaggaaggcaaaggttggctccaaccccagcccagccctctcaccttgcagagctagcaggg

SEQ ID NO: 116 - DNA, 450 bp, Homo sapiens
gggctggctagtcttatcaagggtcaccctgacctccaggaccctatcctttagtgctggcccagctcacccagtgtccaactgaggctgccctccacaggtgtagtgtgttcatcaatgtcattcccatacaggcagaggcctgcctccaggcgcaggctgtccctggctgccagccctgccagcttcacctctgggtttttcagaatagctgttgccaggtgaactgcccccgctaccggcaccgagatctgtatgaaacaccagagggcagatgggaagctccctgtaccacatacccccaacccctcacatgcatcctgtgccctgtactgcccccacaccacttcttgacacacctccacaccatcctctcctgtgtagccacagcgggtcacgcggcagccagacacgccaaacacctccatcacagcactggtcatgaagggc

SEQ ID NO: 117 - DNA, 402 bp, Homo sapiens
aggggcagccactagtcacagtacctgtcaagcaagcataagccacgcatcagcaccaccctgccagtgcccccaccctcctgggaagagacaagggtttcccagcttccctggtccacctaccaatcttggtaccctccatgttcaggatgggactgtgtgcccgcatgggggccccctcacacatcaaccccacacgcctccgctgcaccctgcccttcagctggggaacaatgaccttggctccagggaagtccatagcagctcggcggcgcttccctggagaatgacacatgagacataagccacagcccatagaagccctggccacaggaggtccttatgaggtcctcaagtaacacactatctagcatcaaggcccctttgcttgggctactccag

SEQ ID NO: 118 - DNA, 429 bp, Homo sapiens
gtgtgagctggtccgtcactcagaagcagggtcctgaaggaagctggaatggcatgagttaggtggggggaataggtggtgtggcccctcaaccagacaattagaatcagcctccaccttaactgcccacccccagtgagttctgcctcagcttcttgactaaccccttgtaggggcaaaactcctggaagggacagccccaccctgagccagcttcacttgagggtatagtagtttgtgggcacaaagggcatcttgctgactacagccatctgctgcttccgccgcacctctaccagcagcattgtccctggacgactgtactcgcagggcacataacccatcgccacattcttcttcagagagggggaggggcagccactagtcacagtacctgtcaagcaagcataagccacgcatcagcaccac

SEQ ID NO: 119 - DNA, 450 bp, Homo sapiens
ccatccccaagtttacacacaggcatagcagccctactgtgagtcagcaatcattcctgacttgcagtaaggacaatttgcatttacggaaagcaaactggagggggtagcctaagtccgcactgcccatgttattaccctttgcaatgtgaaaaaccatggtgaggtaggttgggcaggttttatcctctccacaaaggtgagcctttgctccacagccagcacctggcagagtgggagagatggcagaaccaaagcttctcattaccctccagcaggcaagagtaggtcagtgggatcatggactgaaacaagacattgtgtgagctggtccgtcactcagaagcagggtcctgaaggaagctggaatggcatgagttaggtggggggaataggtggtgtggcccctcaaccagacaattagaatcagcctccaccttaactgcccac

SEQ ID NO: 120 - DNA, 437 bp, Homo sapiens
aattgcaagactgttgactgtcattctttggtttagtgggtggagccagctgtcctcattagataaaggttgtttattcaacccaagtataaatggaaaaaaaagatgcgccctctgtcactgagggttgactgactggagagctcaagtgcagcaaagagaagtgtcagagcatgagcgccaagtccagaaccatagggattattggagctcctttctcaaagggacaggtaaggaaaaaagtctttctttgaattcctggaatttagttgaaaattttggacttcaaaatttgtaaggtgttattgtctagttagttcagttttctgatacaatctggccaggaaatgcatattttaaagtcctctcaccattttccaacattgtataattatagtcacatatccacttacttttgtggctcgtgatctcagcca

SEQ ID NO: 121 - DNA, 410 bp, Homo sapiens
tgaaaagggttcctgctgtgagcatctgatggtcatgataatgtctgaagtactttattttttaattgttcagccacgaggaggggtggaagaaggccctacagtattgagaaaggctggtctgcttgagaaacttaaagaacaaggtaatttttaagttgaaaaatgatcagcctgatttcctccccactctgaaggaaagagcaggcccctgtgaacctggagtgtgtctggaatatttacatcagaattgcggtactggttacaacccgagaaacacatcctacaaaagcagcagggcatggggagaatgctcaggaaacattgctggatgtacatcctcactcagatattttgtctttccagccaaactacagtataagataaattgtgtgtgcaagaacgggggt

SEQ ID NO: 122 - DNA, 432 bp, Homo sapiens
tgagatcatcctacacagactgatttataatctactttttaatttagtaactcaaaactttttaattttagagtgtgatgtgaaggattatggggacctgccctttgctgacatccctaatgacagtccctttcaaattgtgaagaatccaaggtctgtgggaaaagcaagcgagcagctggctggcaaggtggcagaagtcaagaagaacggaagaatcagcctggtgctgggcggagaccacaggtcttgttgaataactgtgtctatgggaatctggcacaaaggaagtaaccaaggccataagaagagagaaaatttagaaatatagacagaaaagcattgacctatattttatatcaaattttctgcctttaaaaaaattttataggttacttttattatagaaacagacttcgctcaatttgaagt

SEQ ID NO: 123 - DNA, 392 bp, Homo sapiens
aaccaagtgggagcattgagtgaataatatgatgtatgtagtgacactgcaaacctgatgttcacacaaaattttttccccaaaagtttggcaattggaagcatctctggccatgccagggtccaccctgatcttggagtcatctgggtggatgctcacactgatatcaacactccactgacaaccacaagtggaaacttgcatggacaacctgtatctttcctcctgaaggaactaaaaggaaaggtaaaagactggttggtactctagtgcaatagaatactttttagtagacattcaggaggtggaagggaaatgagaaactccatgttatcttattcttggtgtaatctcaaatcattttctctgcagccaataagcaaagggttggt

SEQ ID NO: 124 - DNA, 375 bp, Homo sapiens
cagcaggactggggcacaaagtaggtaaatgccaactggttcaaggcaaagtcaaagcaatcaaggggaggcacacatcctcttcttaattgtgtattatttttacatgatttcttctgtatttatattctaaatataagatatacgcaatccaatatgtgtctttacctttgaatgtaggatttgttcaagagaatcatacataaccaagtgaaaacattgtaattttagattcccgatgtgccaggattctcctgggtgactccctgtatatctgccaaggatattgtgtatattggcttgagagacgtggaccctggggaacagtaagcttattccttgatgtgatttgcctccatttttgtccctttgtgt

SEQ ID NO: 125 - DNA, 424 bp, Homo sapiens
taaaaggagacaggcgggcacagtcagccttattaattataattatcttaatttctcttttatagctacattttgaaaactctaggcattaaatacttttcaatgactgaagtggacagactaggaattggcaaggtgatggaagaaacactcagctatctactaggaaggtaggattcttttgtgtgtgcacacatgtgtgtgcaacagaaaaggttgctactgacaaccaaagttattaataaagtctttacatgaaataatgggttgctactttttataaaacaagttaacagattattatctatgaaatgtgaagccatcaaccttaaactgaaatcctttcccacttcttaaaagaaagaaaaggccaattcatctaagttttgatgttgacggactggacccatctttcacaccagct

SEQ ID NO: 126 - DNA, 395 bp, Homo sapiens
acatgtgtgtgcaacagaaaaggttgctactgacaaccaaagttattaataaagtctttacatgaaataatgggttgctactttttataaaacaagttaacagattattatctatgaaatgtgaagccatcaaccttaaactgaaatcctttcccacttcttaaaagaaagaaaaggccaattcatctaagttttgatgttgacggactggacccatctttcacaccagctactggcacaccagtcgtgggaggtctgacatacagagaaggtctctacatcacagaagaaatctacaaaacaggtagttaacaatctgaggtaatagagaagcaagtgtacacttgactaatatatatttatacctccttgacctgaaaccaagtcccagctga

SEQ ID NO: 127 - DNA, 447 bp, Homo sapiens
agtgttttccatcggttactacctttttctgttagtggataatctttcaagtctgtctgtactactttcaaaatgtcaactattttataaattacattattacaatttgttgttgtagggctactctcaggattagatataatggaagtgaacccatccctggggaagacaccagaagaagtaactcgaacagtgaacacagcagttgcaataaccttggcttgtttcggacttgctcgggagggtaatcacaagcctattgactaccttaacccacctaagtaaatgtggaaacatccgatataaatctcatagttaatggcataattagaaagctaatcattttcttaagcatagagttatccttctaaagacttgttctttcagaaaaatgtttttccaattagtataaactctacaaattccctcttggtgtaaaattcaaga

SEQ ID NO: 128 - DNA, 416 bp, Homo sapiens
tgggaaggtctcagcctccttgtctgcccagttagaatgatctgatgcccctgctaccatcagacttgataagtttcccaaagactctttgcaagaagcactgttctggagggtggaggagagactaattgttcttgctctcctggccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtacttgccgtggcccaagccccacccaaggccccttccctgtggccccaggctcccaccaaatccctgag

SEQ ID NO: 129 - DNA, 400 bp, Homo sapiens
ctctgcccttcctttgttggggtattgagtgttcttcccatggaaggcagtggggatgcctcagtgggggggtggggctgtggggaccctgggtgccagggggctgctaggccctcacctcctgccatgtgcctcccaggaggacaaggaagctgtgtttgaagtgtcagacactatgagtgccgtgctccaggtggccactggcgtcatctctacgctgcaggcaagacatcacccccctgcttctcctcccctaggtcccaggcactggggtgggcatgcggggagggtggccttgggaggaggtgaggtggggctggaggacctggggcagggaaggagaggtgtgctcgctcctgctcctggggaacagggaaaggacagaaactgctgccatgca

SEQ ID NO: 130 - DNA, 367 bp, Homo sapiens
acaggccagtaagtgttcatagcacatgtaaatattatcgataattatgagaagatggttcaagttgagagtgagacagagccgagtgggtaagagagtatctgcccaaggcagggatgtcctggcagaggggcaggtcctgggcctggcagcttcagatcccagggtccccagggctcaccactcgcccacctgtgcccccagattcaccaagagaacatgggacaggctctcagccccgacatgctggccactgaccttgcctattacctggtccgcaaaggggtaagtgtgtagcagccagggggagggtgaggagatggggtgccccccccagagggtgggggagctcaggaatgggtgcaag

SEQ ID NO: 131 - DNA, 350 bp, Homo sapiens
ggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcaggtacggcccatccccttccccatgctgcctcctaggaagtgagcctgggtgcctggagcccagggtggcctggcgccctggcccacctcttcctctctccccagccccctgttctcgggcgacgtgatctgcgtgtgggactacgggcacagtgtggagcagtatggtgcc

SEQ ID NO: 132 - DNA, 441 bp, Homo sapiens
tgtgttcatggccgagaccaagggggtcgccctcaaccagctgtcactgcaggagctgcagaccatcaggtacggcccatccccttccccatgctgcctcctaggaagtgagcctgggtgcctggagcccagggtggcctggcgccctggcccacctcttcctctctccccagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagaggaggctgctgtgtgtttcctgccccagcctggctccctcgttgctgggctttcggggctggccagtggggacagtcagggact

SEQ ID NO: 133 - DNA, 447 bp, Homo sapiens
agggctgatgaggaaaactgccctgcctgggttgactcctctgggggtatagaccgtgaccctgggtctcccttcacctccaggagctcattggtgcaacggcagggaagctgcacacgggacggagccggaatgaccaggtgctttagcccctccaccccctgctccgtgttgtcccaaccttgaggagcccagggggcagttagagttctgcagcggtcctggctcctcagggaagcaacacatcggcctccctgagcaccatctcctccttgcacaggtggtcacagacctcaggctgtggatgcggcagacctgctccacgctctcgggcctcctctgggagctcattaggaccatggtggatcgggcagaggcgtgagtcctacagggacacccagggggcagacagaggtgtgatggaagcctgaacaggagacctagggg

SEQ ID NO: 134 - DNA, 359 bp, Homo sapiens
ggctcctcagggaagcaacacatcggcctccctgagcaccatctcctccttgcacaggtggtcacagacctcaggctgtggatgcggcagacctgctccacgctctcgggcctcctctgggagctcattaggaccatggtggatcgggcagaggcgtgagtcctacagggacacccagggggcagacagaggtgtgatggaagcctgaacaggagacctagggggcaggggtgaacagcgtgggggtgccaggccctgggggacaggggcatcccagaactccaggatcgaggcagagcagccaggagtgggccatttcctgcaggccccaatactcccatgccagtctagctcagcag

SEQ ID NO: 135 - DNA, 436 bp, Homo sapiens
cctgcagggttccagtgtcacaggcaggccttgcatgagcctccacccgagcttctgctcctcctctcccacagggaacgtgatgttctcttcccggggtacacccatttgcagagggcccagcccatccgctggagccactggattctgaggtgagccaggtgaggtgcaggggctgtgctagaggggaggaccccggctgccctgaccctcctgcccctggcttcccacagccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaagtgcagagtgggacagaaaaccgccttatctgctcagcgggggactct

SEQ ID NO: 136 - DNA, 415 bp, Homo sapiens
ggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttc

SEQ ID NO: 137 - DNA, 419 bp, Homo sapiens
gttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatg

SEQ ID NO: 138 - DNA, 428 bp, Homo sapiens
ctaacctcctcctgccccctgtatggtcaggctgggtggggatgggagaggcctggtgactgggaaccttttctcccagccgagttcctgttctgggcttcgctgtgcatgacccatctcagcaggatggccgaggacctcatcctctactgcaccaaggaattcagcttcgtgcagctctcagatgcctacaggtaagccctgaactgccacctccatctgccgctgccggcctctgtatcccccgccgcccgcggacgtggctgccttcctccccgtcccacccctccgccagacctggccattgcggcgctggaccagccaagggtccagccccttcagcgccagcacctctgtccccagcacgggaagcagcctgatgccccagaagaaaaaccccgacagtttggagctgatccggagcaagg

SEQ ID NO: 139 - DNA, 449 bp, Homo sapiens
ccctgaactgccacctccatctgccgctgccggcctctgtatcccccgccgcccgcggacgtggctgccttcctccccgtcccacccctccgccagacctggccattgcggcgctggaccagccaagggtccagccccttcagcgccagcacctctgtccccagcacgggaagcagcctgatgccccagaagaaaaaccccgacagtttggagctgatccggagcaaggctgggcgtgtgtttgggcgggtgagcaaggcagggggaggggcggggcctctgggctgatggtgggtggccaggggggcaggatcccgggtccagcccctgtgcctccctcttcccgcagtgtgccgggctcctgatgaccctcaagggacttcccagcacctacaacaaagacttacaggtgcgaggccgggggaggcctggctagtacgtgccagttc

SEQ ID NO: 140 - DNA, 431 bp, Homo sapiens
gatcccttgagtccaggctgcagagggctataatggccactgcactccagcctggacaacagagcaagaccctgtctcctaaaacagaaaacaaatcctccaggaacatctgatgcatgctgaagataaggactctttgaaaacataaaggccagtaaaacatacaggccagtaagtgttcatagcacatgtaaatattatcgataattatgagaagatggttcaagttgagagtgagacagagccgagtgggtaagagagtatctgcccaaggcagggatgtcctggcagaggggcaggtcctgggcctggcagcttcagatcccagggtccccagggctcaccactcgcccacctgtgcccccagattcaccaagagaacatgggacaggctctcagccccgacatgctggccactgaccttgcctatt

SEQ ID NO: 141 - DNA, 439 bp, Homo sapiens
aggattggaggatggaggcaacgcccaccccgccgggcggcctcctattggcgcggccgtcgccaggggtggggacaggaccggcggctgctgacgccatcccggccagaaaagccctggccagtggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtgagtgggacctcggggactccggtcctcctagcctccaaa

SEQ ID NO: 142 - DNA, 431 bp, Homo sapiens
gagcagtagttagctgtggcgctaggcagggccccaggacacagggaacggaaggaacaatgtgaactcacacctgggcaatccctgctctctctgggcctcagtttccccacctgtccagtgggcacctggactaggtgacccggctcagatgtcctcttgagtcttagatcctgaaatgctgcctaatgtgtggcctaagctgtgcccaccctgggacagcccagctgggtgggtgactctgagccttgcggtagcgcccgaacctaatggaccagttcttcccacaggggcaagcatggcgtgggccgtattgacatcgtggagaaccgcttcattggaatgaagtcccgaggtgagtctgctcagcctccctcagggcctgcctcgggacccagcaaacccagagatccctgagaccctgtcccctt

SEQ ID NO: 143 - DNA, 443 bp, Homo sapiens
cggcttgtctcctgtcagacgactcattattattattatttttttttttgtcatttgctgacagtttgggtttcatgcgtttctctcttttttctccttttccccctgcctggaaaaatggctaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtgcgtaagactctatggctgccccctctaaccgcctcacaagggatcccaaagtactatcaggctctcgggcctggccctcccctccgtatcagcaccttcctcccctgccgcccactgccatcctcatgtgagaccccaaaaggtgcaggccaaagggggttgagggaaagtgcagggcatgag

SEQ ID NO: 144 - DNA, 415 bp, Homo sapiens
cctccttacccacaggccctttgcaaggttagagggcagggctatgaaagcatggtcctcaactcagccactggcaagcgcacattgtgccagtctcgcgggaggcagtcatggtctgcatggcggggtaaaccatggggcacccttcctgtgccccaggtctccctgtgtcctcgcggtgcaggaggcctccctagtggtatcctgttttcctccctgtaggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgaggtaggtgccccacacctcattctgacccccacttgg

SEQ ID NO: 145 - DNA, 367 bp, Homo sapiens
gcagtcctcccttcaagcagaggccagggccaggctgagctgacaagcttctactctccttgcagcatgaacgtgcagggtgattatgagccaactgatgccaccgggttcatcaacatcaattccctcaggtgagaagctcagggccctgacgggccttcagagcctccaggtgtaaagggtaggctttgagagcccccaggtgtaaagggtaggctttgatgcgaccttgactgctgccctgccctgccctgccctgccctagacaaaccccactttcctgtccatctgcccatagcatcctcagaagcatgctttgatagccgacagtaacagagggtcctaggcattggggtcctaggttcct

SEQ ID NO: 146 - DNA, 450 bp, Homo sapiens
acccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcgg

SEQ ID NO: 147 - DNA, 390 bp, Homo sapiens
cagagtgtgcgaggtcagggttcccgggggtggcaggcactgaaggtgaacatcctgttcccgaccttcagtggcagcttgcccaggagacaaggctgtccaaggccaaggtcggggctgggctgtctgcaggggctggcggggggcactggctgtctcagggtcactcaggttgttcctcgactcccgccagacgctatgtccagcaaaggctccgtggttctggcctacagtggcggcctggacacctcgtgcatcctcgtgtggctgaaggaacaaggctatgacgtcattgcctatctggtgagggagcgacctgggtgtctgtcttcctgcgtgtcctgcaacctgtcctgtctgccccctgccagcctctgtctgggttgtcag

SEQ ID NO: 148 - DNA, 374 bp, Homo sapiens
ggatggtgtgaactcagggctccccccaggggctgacggagcctctccgcttctgcttctcaggccaacattggccagaaggaagacttcgaggaagccaggaagaaggcactgaagcttggggccaaaaaggtaccaggcgggaggcagggatttgggctgggagtggggcggtgatgtggagggcagtggtggatgctcctgccccagggatcccatcccttccagtgtgtcttcttgcttctaagagtatgagatcatcctgctctcaggtgtgtgaaccctcttgtttttctgcctcccccacgccctcttccacccacccaccttcccatccaggtggagtgtctcttccccacccacataccttccct

SEQ ID NO: 149 - DNA, 385 bp, Homo sapiens
agaagaagcaccaggtacagcgggggtggccccgtataggtctcagctagctgaggcccctggggctctgtatgccagatggcccctgtccttgcctacttcttccttctgggctcctcttcccgtaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggtgaggcacctgggaagggccgggcagagggagatggaggcggaggggtgtgggaaggagatgagcac

SEQ ID NO: 150 - DNA, 439 bp, Homo sapiens
actatagtgcgagctctggggctgcaggagcagggcctggccccccaggtcttgccagtggctgggcctccagctccagggggtcagatgtgtcctgcacccacccacgtgacatgtgtgccctctcctatactctgccatgtccccagacgtgcacatctccctcctgccacatgcccacacatacacgacctacactgcatgacctcacatgtgtacacgctctgcccagctctgtctccgccacgggctgtccttgtcctcacgtcctcccccagactccagaacccccatcctgtggctcctgacagccctctgttctgcattgcaggggaacgatcaggtccggtttgagctcagctgctactcactggccccccagataaaggtaggatgtggctcctccccttagcagggagcactagcatctgcagcacct

SEQ ID NO: 151 - DNA, 416 bp, Homo sapiens
tctcatctggggagactgaggcccagggaacagggacccccttctcaccccaacacaccaccattctgccatggagtgcaggctccgtccagccagccccggtgagggagtctgtgtccttcccctccttcatggggctccctctcaccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaaggtatggccgagtctccccaccacccccaacctttccctatagcccccttcccgg

SEQ ID NO: 152 - DNA, 407 bp, Homo sapiens
cttgctcagtgcttcaggggtccttgagatgtagactcaaagtcttctggaaggaacctccaaggtcagcattgcagacacacggtcctgcagtttctctggggcatgtccagcaatagggtccccccagggaggtgaccgtgaccaacactaggaggtagccagggtcttgtctgaatgggggccagagtttggggctctctgaaaaagcagggcccctgggacggacctcacgcgtccttccagccgccttacctccacctgtgctgtctctttcctgcagcaacacgggattcccatcccggtcactcccaagaacccgtggagcatggatgagaacctcatgcacatcaggtaaatcccaccctccacccatccttggtcctcccgggctcattccaaaggac

SEQ ID NO: 153 - DNA, 405 bp, Homo sapiens
cagctccacgggtgactatggtgggcccagaatgtttcaggcaggttggcagcagatgctctggcagagagtaaaaggcagaccaggctcatgggcacaatggggtgtgtgtgttgggggatggggacatgccatgtccctccccagctgaccctgtctttcctttcccctccgcagctacgaggctggaatcctggagaaccccaaggtaatcccccaaaccccatctcctcccagctggccacctttggtggtagcagctccatgccgatgctgtctgatgtatttatagcctaatttgaaatttcacgggggccagccgtggggctggggccgagccctgcctgtgttccccgacccccgcactggcccccctctgcccaccgtctcctcgctgcatttgaa

SEQ ID NO: 154 - DNA, 422 bp, Homo sapiens
tgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcagaaccaagcgcctccaggtctctacacgaagacccaggacccagccaaagcccccaacacccctgacattctcgagatcgagttcaaaaaaggtatgtgcccacctgttgggactcgaagggggttgac

SEQ ID NO: 155 - DNA, 430 bp, Homo sapiens
tttaaggcgtttcgggaggagggagagggtggggtggcgggtgcagactcctccgctgagccgggcccagaggcccactgccctctcttcccaccctaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggtgcggagcacaggccatgtcccttccccatagccacagagtttcccggaccagggggacccatttggcaggagaggctccgtggtccttagccttggaagataacaaccccaggaggtctcctgcctccaagggatcattaggccg

SEQ ID NO: 156 - DNA, 403 bp, Homo sapiens
ctgcacacccaggactgactcagttactctaagagttttctagattatatagacaagaggcattcctgtggaacagaatcagtcataagagctggtaacaaatagcagaaacaactaatttcaacccatttgtatgattttggaatgggcgcaagggtaatcttgctcagtgaaattcatttgaattatacagaaggtaaatataatttgtaagggtcatcctcattgaatttgtgattgcattacatacctgagcataacaagcttcttctatggctaaccctgttactaaatcgacctgagaataaaaacataatccatttcagcagaaataactttgcgaaatgtggtatattcaacagaaattcaaattgaataaccttatccccaaagcacccaatcc

SEQ ID NO: 157 - DNA, 428 bp, Homo sapiens
taacagaaagcctcatatgcagtaaatatttaaaaatgtatatctaactttgattctgtttctgactatacactactagctttataaatctgaatgaatatgacatttacacatttgaatgaagtacacggatgggtccattccagatgcttattacaccgtatgaataatctgctcttcactttggtcattaaggttccatgtgctgaggcatatagtggatccgaaagacacttccaggaagtacatttattacattggcatcttaagaatttctgttccttttattctcctttatagcgagggggccttttctctttaaaagcaagaagaccttcaagtctgtcttttgttggaatggtctaagaaaaacaaaatattaaatatgtcaaaaatgttaaaacaactgtaaaagtttatcaagcact

SEQ ID NO: 158 - DNA, 442 bp, Homo sapiens
caccttatgcccgtcctgagagcgagcggccgcccgctgccccgcgcctgcccagcgttcgcacctcacctcggttctcctcctccaggtgccgcacccgcagctcgtcctccgtcttcatctcagagctgtagccccttttcggggcgggacccccggccgcaggtacccagccctgggcccagatcgccgggcccgctcgccggcctgccaacgagccgggcagcctcaaccccgggcagagccacgcactgcaagcggccaccaggcgggcgccgccagcatgcagggatcccaaggccccaggtgccgccgccaccgcggccgccatgttgtctgtttacggcgtggacctgcgacggccgctccgcccccgcccggcgccgacctgccgcgcgcacgcgcacggcgtccggacccgccgcctcgctccggcttggcc

SEQ ID NO: 159 - DNA, 432 bp, Homo sapiens
agaggagttgttggtaatggggttcaaaccaaagaacattctaatggaaaacagattactattgaggaaaaatcagactacagtttaatttcataatacaacatatttacataccagcacagaatatccctgggacttcactcctgattattatggtccgtactttcttatcagatttcaaagcatccacagcttttgatagctaaacagaaataggaagcataggaggaaaaagagaaaaaaaaaacaaaacatttttacattgatgacaataatatatcttaatattagaagcaaacagtttaatctttacactcaccatttttataagatttttactgagtgaatttttgccataagctctgtttattccaagcaccacaattcctagttaaaggggaaaaaaagtacaagcacttgagtgagcaaggc

SEQ ID NO: 160 - DNA, 385 bp, Homo sapiens
agtgtcacgttaaacagctataggtcatgattatctaattatataaatatttaaccaatgcttatatataatgtgtaactttttaaatgtgacatttaagaaccccttcggcatgctgaaagaagaacttaatagtgcttaccaatatcgttaatcactgctcttattttggagacaaaaggaccaacttcactggaactcattttggctctttccttaaggtcagcacctgcaaagtattttatttacaaatataatctagttgtaaacaaaattttaaggcaaagaattgaaaatttacttaagattagtatacaacttcaagatcagcctaattcatcttttaatagaatgacattacctcagttttccttcccaatgacca

SEQ ID NO: 161 - DNA, 385 bp, Homo sapiens
tcaggtgggaatttcgaaaacaccattaggaccaacaagtgactttttgaaaatattctactcaacaacaggaagcagaataaaatatttaaaattacctgaagagtaaacacaaccttcacttttttaaattatgtttttaacaggattaattcttacctgctactcgtatatcacaggctaaagccagttcaagaccaccacctaaagcgagtccatctattgctgcaattgttggtactggaagattagctgaaatggaaagaaaattttatgcttccttaataagattattatctcactgtgtaattcatttttaatttttttctgtgaatttatgctttaaatgggagatcatatacagacttttgtatcccttttacct

SEQ ID NO: 162 - DNA, 408 bp, Homo sapiens
tggggactttgctagggatgcaaacaatatgccattgtctctttacgcaaaatgttgcctttccaattaacatgattttgccttatgccctgtttctaggaccaaatcaaggatttgaggaatgggcgtgaactactcatacctccaccaggaataatcgccaattttgtttcaaccaggcccatttttgcagaggaagctaaaacgaaagaaagaaaattaagtatcatccatatcatcacattcaaatatgacaacttgaaaaagttatgagatatactaaaatattgtttactaattaaattgatatcacaaattcttaaaaaaaatcacttaaaaggcattgttatggaaataagtaagcactctaaatgacatgtattaggagagtcccacaacattttctgt

SEQ ID NO: 163 - DNA, 433 bp, Homo sapiens
acagagcccacgcatccctttacttggaagcaagccagggacttcttccataggcaagatgactgctgttttagtcaaagtgttataatgtttcctaaaatgagaaaaaataaactcatttaatgagaaatacctgaggtaaaaactctctcgccaggtccaaggccttcctgtaggccgcgtctccctcctggttctgttccagaacgtggctgattaagcccactgctttggcttctttgccatcgaggactcgcgcagagaatatgagctccttggccagggacattccaatggcgcgtggcaatcgctgtgtcccccctgaggggtgaaagagagagaaaaggcaatgatttgacacctgttagttttaacacttcagtgtttcatatcttcatttataaaaataaaccagggccagaagtttatatgt

SEQ ID NO: 164 - DNA, 397 bp, Homo sapiens
tgtcataagcttcagggcactggtaaaattactgaattctgtgcttgtgatactgaattagcaataactgtaagaatgaaataaatgacgtacttgcaaggaacttcagtagctttcagtaatagtagcatttaaacaaccatattttagaactttaaaaaaaatgtagaagtctaaacatggttcatttaaattaaatctccactctccattcccaaaacaaactcaagcattaaggaacctacctccatcccttgattaattgctaattttgccactctcattgcaacaggtccctaaaattcaaattaaagaaacagacttcaattattttttatgcaaattatgtcgtatatctcagtaaaattcagaattcccaccactggatccattgcac

SEQ ID NO: 165 - DNA, 354 bp, Homo sapiens
cccctacccctaggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggtaggaaacagcaggccttagtggaaggcacgggagggggctggggtgagccccactaaggccagcatctggcaggttgacagctgtgccgatctgccttag

SEQ ID NO: 166 - DNA, 407 bp, Homo sapiens
cagggtcctgcatgggaggccggctagcctgcccactgccccatgtccccacaggtgatggaggcctttgagcaggccgagcggaagcccaaacccaaccccaacctactcttctcagacgtgtatcaggagatgcccgcccagctccgcaagcagcaggagtctctggcccgccacctgcagacctacggggagcactacccactggatcacttcgataagtgagacctgctcagcccacccccacccatcctcagctaccccgagaggtagccccactctaaggggagcagggggacctgacagcacaccactgtcttccccagtcagctccctctaaaatactcagcggccagggcggctgccactcttcacccctgctcctcccggctgttacattgtcaggg

SEQ ID NO: 167 - DNA, 380 bp, Homo sapiens
caccactgtcttccccagtcagctccctctaaaatactcagcggccagggcggctgccactcttcacccctgctcctcccggctgttacattgtcaggggacagcatctgcagcagttgctgaggctccgtcagccccctcttcacctgttgttacagtgccttctcccaggggctgggtgagggcacattcaggactagaagcccctctgggcatggggtggacatggcaggtcagcctgtggaacttgcgcaggtgcgagtggccagcagaggtcacgaataaactgcatctctgcgcctggctctctaccacctctggtctttgtttcctggagtttgggggtgatttgaggccacccccagcttctccaccttaga

SEQ ID NO: 168 - DNA, 422 bp, Homo sapiens
aggttgccctcttctttgcctgttacaggagtaactacaatgaggcgattggagaaaattttgggtagatagatttttttttctccaaatctctgtgcattctatctaccacagaacgggaagaagatggttttcttgtcagatggtgctggagtttgcgtcaggcacataaagaggcagccccgaatctagcctacgtgagtgccggaccgctgagtggttgttagccaagatggcggtagcgatcgctgcagcgagggtctggcggctaaaccgtggtttgagccaggctgccctcctgctgctgcggcagcctggggctcggggactggctagatctgtgagtacctgggccccaggcggttttcccaaaggggattagggatgtaaaggctatcttcagagtgtggggtccctgaagg

SEQ ID NO: 169 - DNA, 437 bp, Homo sapiens
ctgatgcaggtggtctcctctgctctcttccccagcacccccccaggcagcagcagcagttttcatctctggatgacaagccccagttcccaggggcctcggcggagtttatagataagttggaattcatccagcccaacgtcatctctggaatccccatctaccgcgtcatggaccggcaaggccagatcatcaaccccagcgaggacccccacgtgagaggcggcctcccccacttcccgtgccccccacgcccaggccccttgcctgtctcctctctggtcccaactgccccacgtctatctgtgcctccacccgcagctgccgaaggagaaggtgctgaagctctacaagagcatgacactgcttaacaccatggaccgcatcctctatgagtctcagcggcaggtgcgtggggacaggactaggggcggggg

SEQ ID NO: 170 - DNA, 426 bp, Homo sapiens
taaaggcaggaaccccagcatggcctggcccaggactggccttcaggaggactgtgaattcatggaggtgttggaagctgggcaggatttggatggctctctgtcattgcccagcataaccaattgtgggaccccggtcccctctacacccccagggccggatctccttctacatgaccaactatggtgaggagggcacgcacgtggggagtgccgccgccctggacaacacggacctggtgtttggccagtaccgggaggcaggtacgtctgtccgtggtttggccctgtggtccccattgaagtgtacactttagtttttctgagtgttcttccaggagcagcatagtgccaggaaggtctaaggagctggaagaagagctttccaagcaagaaagagacaagccagggttaggactctggagg

SEQ ID NO: 171 - DNA, 440 bp, Homo sapiens
tgggtgttcaccagaggttttgtttgaagaaaaggttttactgccatacatgggttagagtacttctgtagtccagaagttgtaaattagtggtctatgctgttatttggttcataatgatgattttttttttttttcgagacagggtcttgctttgtagcccagattggagtgcagtggcacgatctcagctgcctgcagccttgaacttctgggctgaagcaatcctctgcctcagcctcccaagtagctggaaccacaggcacacatcaccatgcctggctaatgttttgatttttttttttttttgtagaagcgaggcctcaccatgttgctcaggctggtctccaactcctgggctcaagcgatcctccaacgtcagcctctcaaagtgctgggattacaggcatgaaccaccatgcctggccatagtaatgatt

SEQ ID NO: 172 - DNA, 396 bp, Homo sapiens
cagtcagtctgaacatcagtcttcctcttaaaacaagcctgagctttcctgtctgcctgccagcatgctgcaggtcacccacagggctgaactgtccccctgtactgcccactcggctaaccattgcctcctcccctcctaggtgtgctgatgtatcgggactaccccctggaactattcatggcccagtgctatggcaacatcagtgacttgggcaaggggcgccagatgcctgtccactacggctgcaaggaacgccacttcgtcactatctcctctccactggccacgcagatccctcagggtgaggatgcatgccctgtaccttgcacatgtgcagaccaatgtcacacccctgtccaggcctcagctcttttgcctgccttctgggtggaa

SEQ ID NO: 173 - DNA, 397 bp, Homo sapiens
tcctttccccttgaagcctggtgactgctggcctgagccacgcttgagccgtgggtcatgtgagtgtgaatgagtgtgagtgcatgtgagtctccgcccctgctcaccaccctctcatcccctgcagcggtgggggcggcgtacgcagccaagcgggccaatgccaacagggtcgtcatctgttacttcggcgagggggcagccagtgagggggacgcccatgccggcttcaacttcgctgccacacttgagtgccccatcatcttcttctgccggaacaatggctacgccatctccacgcccacctctgagcagtatcgcggcgatggcattggtatgggctctgctggctgctccccaccccgctgggatcatctccttccctccccaatcctgc

SEQ ID NO: 174 - DNA, 448 bp, Homo sapiens
acccctaccctccttcctggttctcgtcctgtgtcctgtggcgtctggcacttggtcagccacaggagttgaggtcctgagcactcagccttgctctctgtcctctccctgctcgtccccttggcctcgtgcatgttccttatctcagccctggcctgacctgccttctctgtgtccccacagcagcacgaggccccgggtatggcatcatgtcaatccgcgtggatggtaatgatgtgtttgccgtatacaacgccacaaaggaggcccgacggcgggctgtggcagagaaccagcccttcctcatcgaggccatgacctacaggtgcctgccgctccccccgtcagcacccccacagcactgacagccaccgtagcatcttcctcatatcgatcactgtctccaaaacatggccttatcacctgatgttgcatctcccccttgcct

SEQ ID NO: 175 - DNA, 428 bp, Homo sapiens
tgacagccaccgtagcatcttcctcatatcgatcactgtctccaaaacatggccttatcacctgatgttgcatctcccccttgcctttattccgtttccactcctccttccctagttcatcccccatcctccctcctgacccccactccagggagcccacactgacctggggccccttgcccctgtgcaggatcgggcaccacagcaccagtgacgacagttcagcgtaccgctcggtggatgaggtcaattactgggataaacaggaccaccccatctcccggctgcggcactatctgctgagccaaggctggtgggatgaggagcaggagaaggcctggaggaagcagtcccgcaggaaggtgagggtgccccgcccgggagggtgtgctgggggctgctgcggcctgcagagcttgggaaggatt

SEQ ID NO: 176 - DNA, 386 bp, Homo sapiens
agatgactgacctgtcgaaagcgagttgtaacttattggcatacaattgaattactgatttttacactatttattgaatgtatataatttacttttattactgatttaaaactaccatcatatatataaaatagatattctttttaacatcaggtttttcttttctctttcagtctgtgatcaaaacagggcgactgctaatcagtcacgaggctcccttgacaggcggctttgcatcggaaatcagctctacagttcaggtagagtaatttttggaactgatttcaatgcttgtgcaattccacatgccaattccagaagaaaataaattacttatcacaatatgtgaaagcatacactttatggaaatgtagtgcatgctttca

SEQ ID NO: 177 - DNA, 441 bp, Homo sapiens
tgcgaacatgctgttacctgcttttttcatattacagtatacttaaatatttttaatgtccttagatgcaattgtatttttagtaagtgaaatattttaagttgcactatttcatttctgtgagtaaaaaaaattcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttggtaaaaggcaact

SEQ ID NO: 178 - DNA, 432 bp, Homo sapiens
ccgaccaatgtggaagcctcctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacggtgagccctgggactgcccactcggtcccgctgcagcccggactcccaggctcgcaggcgcccgcgaggggcaggggccggcaggctgcaatccttgcatcccagcttattaacttcctgactctctggaacctccttgcctcagg

SEQ ID NO: 179 - DNA, 432 bp, Homo sapiens
aattacttatttctcattgttagtattatttagagattattaaataaaatgtattatttaaatactgtttttcagtaatatttggtgaagatgttgcctttggtggagtctttagatgcactgttggcttgcgagacaaatatggtaagtaaatacctatatgaatagtattctgatagaacttttactaaaagatcttaaaaatacaaaatatgcctactaaattttttgtcatatccccattgtatggatgaattccttttcatttccaacgccacccgcagaatcctttggcctatattttctcaaatgtcttctagtatccctctgatctagttcatattacacatacagtgtaaatgattccaaaataattgtcattaaatgtatattatttattgtgtcattcttctgtccaagaacctttggtgt

SEQ ID NO: 180 - DNA, 350 bp, Homo sapiens
tattttctgtttcctctacctgttctatacttctccatcccattattagtttactgaatttttaaatgtattatgcatgacattactctcatttgccacattaacctttttttcttttctattttaaggaaaagatagagtttttaataccccattgtgtgaacaaggaattgttggatttggaatcggaattgcggtcactggagctactgccattgcggaaattcagtttgcagattatattttccctgcatttgatcaggtaagtgaatgaacatttctaaggttgttcattcattgaaatattcaagtattgccgctacccttccacccacccttacctgcattct

SEQ ID NO: 181 - DNA, 389 bp, Homo sapiens
cattgtgccatgccccgtctttctttctgaccctcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtatgttcatttatgtactttatttgatttctatttgatgtttccattttgattcattctatttaatatctatgcttatctagaggaaagaaaacaaacaggattcttggaatttatgtgaacttaactgtatttaagaaggggaggttagcagttcttttaagtatgctatccaatgcccagttttacagcaagt

SEQ ID NO: 182 - DNA, 432 bp, Homo sapiens
acctgtctttcacaaaagcttaggtcttttgatggtaaaaatattttgagttttttatgtcttaattttttgtattatcttttctgtttctgtttactgaataagcttttcaggggatcattgtagaaacccatagatgtgtgaatccagagatgtatatttgttttttgaccacatgaattgattgtgagcatgtgtctatgttttattctttttttcttatttgttttttctaccagatcaaagttataagcttatcttagttgagtagatgttgcctgatttttgaatgtgagctagaagttgtagactgggaaagaagccatgtgcgaggcaagttatttttgtgcttgagctaaacattaattcacatttaatatttataacattatattgtttttaagaacagatcttttctgtctgtcccctgcc

SEQ ID NO: 183 - DNA, 422 bp, Homo sapiens
tcagcccttcttagcagcgagtttactgggatatatttttactaaaattgtcttaaaaaaatctgtttttgcaggtggttatacccagaagccctttccaggccaaaggacttcttttgtcatgcatagaggataaaaatccttgtatattttttgaacctaaaatactttacagggcagcaggtaaagattttctttattttatatttgtgaatatctttatatactttgttttttatagctctaaaagttatatcttttttttctatatggttgatttatattttccttgtagaaagaatcttgatttttttggtatttagtttgtcctcaggtgtaaattttatgtttgggaaaaattcatctagccattttatattttgattgtggaaacaaagaggaaatctgaagtggtagcaaca

SEQ ID NO: 184 - DNA, 406 bp, Homo sapiens
tgtgcagtaatgtcatggagccatatcataaatgctatttctgttttaagtaatacagaatttagagaaacaaaaaataaaataaagctttgctacagtgagcttcttaaattattttatgcacaagtgtcacctcagaaaaaatgtccttttttttttttcctgttctgtatttagcggaagaagtccctatagaaccatacaacatcccactgtcccaggccgaagtcatacaggaagggagtgatgttactctagttgcctggggcactcaggtgagtagcattgatcccaactgttaaaacctacgttgtgcttggaagctctcattttaaatcctgatacatgaaaaattgaaaacgatgttttctttatatctcagattaagtctggtgctactgatgct

SEQ ID NO: 185 - DNA, 450 bp, Homo sapiens
tctacatgctttctacgtatttgtatgacttcatttaccttctacatgccatctttgtaatcagtatctgtggtactgacttctctctctaagcacctctttccatctgttttctagacatctatacttgttattttcgcagaatatgggcttcaacatatttaaaacaaatttataaattctccatgcagatcagttcctgagactttaaatactgtctctaatagtgacatcagcattcaactagtttttgaggctagaacctttgtagtcattctctgcatatttttctctttatttcaggttcatgtgatccgagaggtagcttccatggcaaaagaaaagcttggagtgtcttgtgaagtcattgatctgaggactataataccttgggatgtggacacaatttgtaaggtatgaatataatggtgatagaatgtcatttccctg

SEQ ID NO: 186 - DNA, 444 bp, Homo sapiens
cccagaccactcactttgacgggtctccctttctgactttccataggtcttattgtctacacgcatttagtcacttggttatattccttcttcctgttttatacttttacaaaaaattgtttaatatgggtaaattttgccccattaacaagcttctccaggtctgtattgcttttgtatcttatagtattattgtaaataattcagcaatttgcataatatctttctttgtaccttgattttagtcaagttgtaattaactgttaagaaactggttgtttttatgtattttacaacacacgaaatgattttttttttgattttcacagggcaaactcagaaaatgaatcttttccagtctgtaacaagtgccttggataactcattggccaaagatcctactgcaggtaaccctgatatgtgcctgaattgtggtagctgtgt

SEQ ID NO: 187 - DNA, 441 bp, Homo sapiens
ctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaaggtgcgcaagggggcagccagcccagggtccgggatgtaggcgggagggagagtgttgggggttctctgctcaaggcctctctccctctct

SEQ ID NO: 188 - DNA, 441 bp, Homo sapiens
atgtaggcgggagggagagtgttgggggttctctgctcaaggcctctctccctctctagccctcagtccgcctaacgcccaccatgatgctctacgctggccgctctcaggacggcagccaccttctggtaagattcacgccctctattttcctcgtggatcctggagctctcccagacactcaggctccagccccgccttcccttctcattttctcccagaaaagtgctcggtacctgcagcaagaacttccagtgaggattgctcaccgcatcaagggcttccgctgccttcctttcatcattggctgcaaccccaccatactgcacgtggtaaggtagagaggaccttaggtcagcgggccaccctgccccgggggcaagtggggagtctggggcccagagtggcagacgattgcttgcctaaaggtgtcagggccac

SEQ ID NO: 189 - DNA, 427 bp, Homo sapiens
atcattggctgcaaccccaccatactgcacgtggtaaggtagagaggaccttaggtcagcgggccaccctgccccgggggcaagtggggagtctggggcccagagtggcagacgattgcttgcctaaaggtgtcagggccacacaggattcaaccccaggccttcagaagccaaaggtgtgtattcacggagcctggaagggtcgaagtgggggtttgatcacgtggtcgaccagctgggtggtgatccccatgggtaggtgggggtggctgttctctgctcagtgcccatgcggctttgtgaattcccacacctcttccttgcagcatgagctatatatccgtgccttccagaagctgacagacttccctccggtgagtgctgggccagagcagggtgaggggctgagaggttgggcttggaccac

SEQ ID NO: 190 - DNA, 428 bp, Homo sapiens
cccatgcggctttgtgaattcccacacctcttccttgcagcatgagctatatatccgtgccttccagaagctgacagacttccctccggtgagtgctgggccagagcagggtgaggggctgagaggttgggcttggaccacccttcctcatgactctgtgacctgcagatcaaggaccaggcggacgaggcccagtactgccagctggtgcgacagctgctggatgaccacaaggatgtggtgaccctcttggcagagggcctacgtgagagccggaagcacatagaggttggggcagcaaaggagaggccgggcctgctgggggtgggaagggcacgggattctgagacctcactctttacaggatgaaaagctcgtccgctacttcttggacaagacgctgacttcgaggcttggaatccgcatgt

SEQ ID NO: 191 - DNA, 400 bp, Homo sapiens
ggaagggcacgggattctgagacctcactctttacaggatgaaaagctcgtccgctacttcttggacaagacgctgacttcgaggcttggaatccgcatgttggccacgcatcacctggcgctgcatgaggacaaggtggggctctgggacctgagacccacctgggaacattaagtgagacagaggagactgggctggggatccgggtcaagggcctgggggctgaggctgtggggctggtgctttggggcagttccgaagttgccagcatcttggggtggggctaggggcgtgggtagtcctgacctcctttctccggccagcctgactttgtcggcatcatctgtactcgtctctcaccaaagaagattattgagaagtgggtggactttgccaggt

SEQ ID NO: 192 - DNA, 436 bp, Homo sapiens
ctaggggcgtgggtagtcctgacctcctttctccggccagcctgactttgtcggcatcatctgtactcgtctctcaccaaagaagattattgagaagtgggtggactttgccaggtgaggcaagaatggctcagggggtgggcagacatctggggcagggaaggcttgggtctgagcccttgcccggggcatgatctgcggggagcagggtttctcaaccatggcactattgacatttccagccagataattctttgtcacaggggctgccccgtgcacgttaggaagttcagcagcatccctggcgccagcagtactgcctagttgtgacaaacaaaaatgtctctgcacattgccatatgttacttaggggggcagaattgtttccagttgcaaaccactggtggaggggcccctgactgaaccctcgctccta

SEQ ID NO: 193 - DNA, 449 bp, Homo sapiens
gcagggaaggcttgggtctgagcccttgcccggggcatgatctgcggggagcagggtttctcaaccatggcactattgacatttccagccagataattctttgtcacaggggctgccccgtgcacgttaggaagttcagcagcatccctggcgccagcagtactgcctagttgtgacaaacaaaaatgtctctgcacattgccatatgttacttaggggggcagaattgtttccagttgcaaaccactggtggaggggcccctgactgaaccctcgctcctatccgcagacgcctgtgtgagcacaagtatggcaatgcgccccgtgtccgcatcaatggccatgtggctgcccggttccccttcatccctatgccactggactacatcctgccggagctgctcaagaatgccatgaggtggggtggcttgatgtgctggcttgggggc

SEQ ID NO: 194 - DNA, 425 bp, Homo sapiens
gtgtccgcatcaatggccatgtggctgcccggttccccttcatccctatgccactggactacatcctgccggagctgctcaagaatgccatgaggtggggtggcttgatgtgctggcttgggggcggacaggaaccggggtgcttgtacctactggtctttcccctctgcatagagccacaatggagagtcacctagacactccctacaatgtcccagatgtggtcatcaccatcgccaacaatgatgtcgatctgatcatcaggtttgccctgagtgggagttgagctgaggtggatgggatgggggtctaggcactgtttctgacttgatttaggaccttgagccccttcctgccccattctgggacttggtccctgaccagacaaactattctctgaatcctgagatggccatgagctgctt

SEQ ID NO: 195 - DNA, 446 bp, Homo sapiens
tgagccaagcccattgttgttgccatcttgctaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttgg

SEQ ID NO: 196 - DNA, 433 bp, Homo sapiens
caagcctctgaagcctcctgtcctgtccccctgcccacccccagctttggcttcgggttgcccacgtcacgggcctacgcggagtacctcggtgggtctctgcagctgcagtccctgcagggcattggcacggacgtctacctgcggctccgccacatcgatggccgggaggaaagcttccggatctgaccccacagcctttggcctgctcacccgaccagcctgggccgcattccctgcaggacctcccgggtcaggcagggcggccccctgctccacacactgctgcatcttgggtctcagggacccagacagatggacttacatggagctgggcactgccctgcctcaacagggtccattgcctcctcgcctccagaacttggagcagggaagtgggcaccctgaggcctccagcaccagttccgtcatt

SEQ ID NO: 197 - DNA, 434 bp, Homo sapiens
cctcaacagggtccattgcctcctcgcctccagaacttggagcagggaagtgggcaccctgaggcctccagcaccagttccgtcattctcgttcctggggaacccccactctgacctgttattaaagttcacattttgaatgccctctcgggccccgtgtgtggggagggcaggtgaacttttgtttctgcccccattcaggttcactgagcccttgggttgaactggttcgtgtcccagtctcttacctgccctgagagcctggcaggccaggagtagaatgggtcccaagtctgttgcatgtttgatttggtgggagtgggatgactgcagcaccttatacaaagagctttcattcatcttgttgaacaaatgtttccgggtcccagataatattgaaggcccagactgacccagcttcgggcatcagtttt

SEQ ID NO: 198 - DNA, 432 bp, Homo sapiens
tactgcacctctgacggacaggagggcaaccaactgccttaaacaacgggaaggaagaggcggtctaaattcgtccacttcccgggagaggtgagaatgtaaacacgcgcgttctccaatcagaactgcgctctcttctcggctcctccattcgcgcgccagaatgccagagggaggcgggactagcaggagattgctgcctatgcaaagcaggtaagaagccgaactctgaggcctctcgccattgtctccgagtcggccagctggagcgttttcggggctgtaaagggagaatggcgcatgcgcatattcagggcggaaggcgcgctaagagcaggtacggagggggcgtggtgcggcgcggagggggtgtggtaagggcgtgcggtccagaccccgccccgggcgcccagttggacttggggagggctg

SEQ ID NO: 199 - DNA, 431 bp, Homo sapiens
tccctcaggctttgttccacaggatgtgacatctcctctgccaacttttcctgcctcctttcctaatcataggattgctattctccctgacaagtaaagaatgacaagatattttattaaaaagatgttttatttatcttttaaagattttttaatgtatgtatctgcctctgaaattattaagaatgccttaataataatccctctcattttatttcagaagacactattgtaatagcatggctaggaaggaaacacagctaattattaagatgaatcatttagcaaggtggggaaaaatcccttgtgtgtaaaaatatctagtgattgacatattaccaaatttacatgaaatagatttccatgtaattgagactgatttttcctattagatggaaagaaccttcctgatcaggactggtgttggggga

SEQ ID NO: 200 - DNA, 399 bp, Homo sapiens
ttcagctgttttccccttgccccattacattccagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggcaagaatgctcctcggaacctgagtttctctcatacagagcagattgctctttaccccttgatcagtggttgggtaatcccaggcttcctaccaccct

SEQ ID NO: 201 - DNA, 355 bp, Homo sapiens
cagcggttcttcctgccatctgataacagactattctttgatgttttcattttcaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgattcctgcctttttcctcagtaggctgagggtacacagaggtgatctaagtcagggaccagaagctgtgacatgttaactaagattgataggagaccttaacatccccaaaatccaacccaaactcccaaagatccatgtgccaca

SEQ ID NO: 202 - DNA, 450 bp, Homo sapiens
aaaacctcatttatttacacctttttttcctctaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcct

SEQ ID NO: 203 - DNA, 447 bp, Homo sapiens
tgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggcta

SEQ ID NO: 204 - DNA, 450 bp, Homo sapiens
cctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgtggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtat

SEQ ID NO: 205 - DNA, 450 bp, Homo sapiens
gctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccacaaagcagtggcttggggtttttttttttttttttatcttgttgatcaagtgacacccagga

SEQ ID NO: 206 - DNA, 406 bp, Homo sapiens
gagtgctctcctgcctgtcacactgggcagggccagcacaggcagcgggtctccggccgagcggtcttaccagggcttcttctccgtgaggtcctcctccttcagaaagcccttctgcagcatccacctgtcgctcaggaacttggtcctgcgggatgggggagtcaccgagtccccgcagggccccaccgggcccccgcccctgctgagtggcacgcactgcctgcccagcccctctcctggacctcactggtgcagcagagacccccaagtgctggctggaagccccagggggaagcctgggggctggacttcccgcccccatggccaacaagcgtgtgtgagcatgcacacagccatcgctcaggcactcagataaacacgtcctctcatgctcgctctctgc

SEQ ID NO: 207 - DNA, 449 bp, Homo sapiens
gcagacagaacccaggactgagctctgagcaggggctgagactgaccccgcctcatccaccacgggcgcctggtcgaagcccttctcccggaggatctcgatggtgtgcccacaggtgatggtcgggagcacggtcagcggggctgacaggcccagctcctgaacacggaggtgccaccacctgagggaagagggcaggtcggggggatcaggataaggacaaacgctctcgcacccccgccggcagcacctcagcaggaggccacagggaccgctctcctgcctgtcacactgggcagggccagcacaggccacggggaccgctctcctgcctgtcacactgggcagggccagcacaggccacgggggagtgctctcctgcctgtcacactgggcagggccagcacaggcagcgggtctccggccgagcggtcttaccagggcttctt

SEQ ID NO: 208 - DNA, 449 bp, Homo sapiens
gactgcgcatctgtttgagctgcctgtaggtgactgggtacctgtttgaactgcttgtagatgactttgccaacttggtctgacggctgcaccttcccggcaagcagggacgagagcatgttcccaagcgtcaccattcccaggattaccctgtgggacgggggcaggcaggggtcagcgctcatacctcacccctcccaggacggtggggcacacgctcagctgccccagggaggagcgctctctggccacacatggaagtcctctgccacgagcctacacgcggcaggaaccagtctgggccctggtggggagaaagaaaccaagagtccttggacccgttcagccagggtcaagggtgaccagccgtcaggtttccgcgacgtggggctctcagtggtcactgggcatgtgtgccaaggctttctgctgtcagacatgtcctcggg

SEQ ID NO: 209 - DNA, 405 bp, Homo sapiens
tgagcctctgcatgctggacaaagggccctacccagtgtggcctgatgaggggtccctgcaggaatcacaggtacagcccaccagcccagggcatgtgggaggcccaggcataaagactgggtgtcactgaaggtcggcaccacccactcccctaacaccccgcaggggatggggggcccagctgctgcccatggcagaggccaggcttggtggcctgaccccagtgagaaccccacgcacagagcagggccccactcacactggatctgctcgtgcaccaccagggcgaagtggtccatctccaggatgtgcgagagcctgcccagcgtgtccgtgaggcggatctgcaagggaagcgtggtcagtggcagggggaacatggccccacgagttttctgtggagt

SEQ ID NO: 210 - DNA, 419 bp, Homo sapiens
gactttccgacaagggccagctggtggtattttaggtcttgggggccgtgccgtctctgttatgagcacgcagccctgacgtgcttgaaagcagccacagacggtggtgacaagcgtggacatgctccaggaagacttgatttggggaccctgacattggaatttgcatctttttttttttctgagatgttcaaacacaagtaaatgtgagattaagagggggatccctcctacccaagcttgggggtgggtccaggaccctggaaggcctccatttgccatggggaggctgtgaatctgagcctgagagccattctgaggggtgggtgatacctacctgcaggcccccccaccacgcctgcccaggcctggtcctgcgctgcagagccaaggacgggagatggggttagacttggggc

SEQ ID NO: 211 - DNA, 410 bp, Homo sapiens
gctccccacacatcctcttggtcctgcgtctccacaggaccctacaccagctgtcatgaggcacagaggggtgagcaaggtgcgggtgaggaagagccctcggagcccgtcccaactccgccacggctgtcactcctctctttgtaggcagaggtcccttggggtggcccacttagagccccaggaaaagatagggaacacagatgagatcagctccttgcattttggggaaacggaggcacagcaactgttggagaagggagccctgggagccctgagtgccgcaggcttctgtggccctggcagctcggcccagagtcaatggactagggccagccaggggactttccgacaagggccagctggtggtattttaggtcttgggggccgtgccgtctctgttatgagca

SEQ ID NO: 212 - DNA, 450 bp, Homo sapiens
gcctttaatccactctgcgcagtcattgcctgtgttcatcctacctggccgacttctctctcaatatttccttggtgaaacatcctaagaggaagttacattagagaaaatcacatatttcatctcataggccgtaaacagggccatttaggaagccatgtgttaacgaggggagacggatgctctgtgccgtgtgcagggataacggtgccaggccaggcagttaccaatcacgcgtgtgtttagggctcaggaaagcgaaggagaagtgggcaagggtggcgggcccgctccgcaccgcccagcgctccggacttcacttctggtcccgctcctgggcggccacgaagttcagcaagtcaatggcggtgaccaccccgaacaccatctgccgctgactggacttcccggtgctgtggtctgaggggagaacgaggcagtgggtttgca

SEQ ID NO: 213 - DNA, 442 bp, Homo sapiens
tggctgtgtggtgtccaggtaacaaactcctgccctccaggttatggatcagccctcttgtgatcaaaagcaggacttacggggcagtgtggtgatgtggggactcggaggcaggccggcccagctgccaggtgcacctgctcggagcatcgggccggatccacaggggctccttggcttccttatcctctggggaccccttctccaggctccccttcgccgagtgtggccctgagcggtgggggcagcctgtgggccccacttctgcctggggggtctcagaaggcatgctgggacctggcaaagcaaggagagaggcgtcggttcaggctcggatgctgtggggttccagcgaaccctgctgacccggccccctctgggaggcgtgctctgctccctcagagaagcccaggaagaactgcacaaaaacacaggcaccagc

SEQ ID NO: 214 - DNA, 372 bp, Homo sapiens
ggaagctaggttgggacacaggccggcagcgggtgcaagatgccagggagcaggcggccaggcgggccagcacatgcggctgcagctcagccatcccccccgggtcccggcaggctcggcatgggtaggggacagccagccctggccaccccctctgggcctggcacccaccggtgttcccggatgtcggctcgataatcgtgtccccgggcttcagcgtcccgtcgcgctcagcatcctcaatcatccgcaggctgatgcggtccttcacgctcccgcccgcgttgaagaactcacacttggccactgggaggcagagatgaatcacagaggggaccccctgaccacccccccattgattcctgctcaccc

SEQ ID NO: 215 - DNA, 439 bp, Homo sapiens
cctcacaatctcagcccccagtgcccgcagcacgtccacctgcaggagggaaagcggtggcctgcaccttccgcctggcccaggcaccctcatcccctgccctatgaccccgcccctggccacgcccacccaccttctcggagctcatcttctctggcatcacgatgatgcagcgatagcccctcactgccgcagccagggccagcccgatccctgagggcacacagagggtgagaggggcccagtgaccccccaagccctgccccgcccctgcctgggacacaggggcacaccccgatgccggttcccttagggcccagggaagagggttctgtgggattccaaaattgcccaacatggctgcttctgccttcaagtgcagggggagagaggctgccagaggcagaaataaaaggtacacgtcaaggaggaggaggca

SEQ ID NO: 216 - DNA, 424 bp, Homo sapiens
actgctgcaggatctcatcagcggtggtgtcgtagtgagccagggggttgctggcgttgcggtactgcatagaaagagagcagagcccgtgagctgacccctgacacctcagtcacccccacatccctgaccgagaccctcctagggaatgcctgtctccaggccccaggtgcctcacctggtctaggatgtgagaattggggatttcgttcttcagccgccaggccacccccacgtgtgactccggggagtcgaacctggcattggtgggcgtcctcacaatctcagcccccagtgcccgcagcacgtccacctgcaggagggaaagcggtggcctgcaccttccgcctggcccaggcaccctcatcccctgccctatgaccccgcccctggccacgcccacccaccttctcggagctcatct

SEQ ID NO: 217 - DNA, 416 bp, Homo sapiens
attatctgcaggaggagcccctgcagacctgcagagattgctgggtaaacaaatacagccatgccctgtgtttgctattacaggtaaaccacaggcggaggccaagagggcacaacggagggaggaaattgttctagagaaatgctctagaaaagcatttcacagagggaacatttgagctgggttctgaagggtgaataggagttcaccaaggagagggcaagagatgtgtacactcccaggcagccagggataaatgcaatcaagatggacagagggacgcaccatcacactgctgcaggatctcatcagcggtggtgtcgtagtgagccagggggttgctggcgttgcggtactgcatagaaagagagcagagcccgtgagctgacccctgacacctcagtcacccccacatc

SEQ ID NO: 218 - DNA, 440 bp, Homo sapiens
cgtgaggaatgacagctttcagctcagaagccggggccactccgcactgcccctctccggcccggccacaccactcaccctgcatccaggacacttctccttcagcttcctggcaatgcccgtgatggtgccgcccgtgcccactgaagccaccagcatgtccagcttccctggtggacggataacattcttgggtccctgcctggccagcccatcactcatagtaataatcattgaaaacacactcagcccaaaccacggtgggtaaccaaaaagttcaaaagaaaaacttcttctccagttggagcagccctcgttgctgcccttggtctgtgaaagcctcagaaacaggcagcctggggcaccccagcccagtctttgctcagtgacactcgacccctaaaacccccatttggctggatgcagaaagacaggaccct

SEQ ID NO: 219 - DNA, 421 bp, Homo sapiens
gagggtgagttacaggctgcaccggcactgtggccgggctctggactcgacctaccgtcctgtccagcaccgtggggatgaagtcgtagccgatcccttccacctcgtaggttgtctgctccgtctggttcagctcctccggctctgcgaggatggacccttcgggatccaccccaatgatctgcagagggcgcggcttcagggctcaaggccagcaaaagccccgcctggacatgcctcgatattctattatgggagtggccaataccgccgttaacaactgcctgttaatgatctgcctgtgggtggtggcctgttcccagcctcagaggcaggatgagaaacccaagaacccaggctccaagtattaaagcggtaatgacctaaatgttcagtgcagggcgctcagaagtaaaggcag

SEQ ID NO: 220 - DNA, 432 bp, Homo sapiens
tgccatgagagcttcagccttgttctagaaacacattctggaaggcagctcgaagccccgccccatggcctcctgccctcacctgagcaggtgaccacactgggcaggcagacaacacctgaggctcgtggccgccgcagtgacactcctcagaactgctgtcttacacatgcaggtcggtggctgactgagggtgcgcccccagccatccccagtgccccctagccatctctgccttccccatacccccgtgcccgccacccactcaccgcacagcagcccctcttgcgcgatcagcatgcgggcaaaggtgaacgcctcctcatcgttgctcttgaaccacttgtccaccacctgagcaggaccccaccacagcccgtcagcgtgggagccgctcccacgtgaccaagagggtgaacagcctcatggtgg

SEQ ID NO: 221 - DNA, 381 bp, Homo sapiens
gaagggtggcaggatggagaggagcagggacctgggagggaagccgtgtcttacatgtagttccgcactgagtcgggcagaatgaccacgcagcgctggccctcctgcagctcctgcgcggccttcacggccaccgccaccgtgctgccagcactgccacctgcagagagggccacgagtcagacgcgccagggtgagcgtgcgtgggtgcacacgtatgcatgaattgtgcacgtgcacgcatgggagcatgtcagacacactccgaaggatccgtcaagaggggttgcctcggggagaggggctgggaggaccccacttctccgtgagcatcggcttcttccttgtgcaccatggagtttctgtgtccactcggggctt

SEQ ID NO: 222 - DNA, 422 bp, Homo sapiens
ggtcacctgttcgttccctggtccatctgctggggagtcactttggtcaccctctgacacaatgccctgttgtgtgtttttcccaaacttaagctgatatgttcttggccactcattaaccagcgagttttctgatcccagggccttgcctaagggatccatcccaggaccccccaggaccccccaggcccacggagcccagtgtagatggaggaagcccctctccaaagccagggcactcacagagctcacacttcaggccgaacttcttcccaatcttgttgattctgaccataggggtgtccccgattttcttcagaatatctggcaagatttttggagattttgccctgaaacagaggagtccacaattattcaggaaaaaaaaaaaaaatagtaccagccctggcagacattgtctt

SEQ ID NO: 223 - DNA, 385 bp, Homo sapiens
gtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttg

SEQ ID NO: 224 - DNA, 399 bp, Homo sapiens
tggatcatgggccatgtgcttttcaaactaattgtacataaaacaagcatctattgaaaatatctgacaaactcatcttttatttttgatgtgtgtgtgtgtgtgtgtgtgtttttttaacagggatttggggaattatttgagaaagcaaaacaaaacaataacaatagaaaaacttctaatggtgatgacagcctcttcttcagtaatttctcacttcttggtactcctgtcctgaaagatattaatttcaagatagaaagaggacagttgttggcggttgctggatccactggagcaggcaaggtagttcttttgttcttcactattaagaacttaatttggtgtccatgtctctttttttttctagtttgtagtgctggaaggtatttttggaga

SEQ ID NO: 225 - DNA, 393 bp, Homo sapiens
tatacacttctgcttaggatgataattggaggcaagtgaatcctgagcgtgatttgataatgacctaataatgatgggttttatttccagacttcacttctaatggtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcc

SEQ ID NO: 226 - DNA, 407 bp, Homo sapiens
tgtgcctttcaaattcagattgagcatactaaaagtgactctctaattttctatttttggtaataggacatctccaagtttgcagagaaagacaatatagttcttggagaaggtggaatcacactgagtggaggtcaacgagcaagaatttctttagcaaggtgaataactaattattggtctagcaagcatttgctgtaaatgtcattcatgtaaaaaaattacagacatttctctattgctttatattctgtttctggaattgaaaaaatcctggggttttatggctagtgggttaagaatcacatttaagaactataaataatggtatagtatccagatttggtagagattatggttactcagaatctgtgcccgtatcttggtgtcagtgtatttgtttgcct

SEQ ID NO: 227 - DNA, 391 bp, Homo sapiens
tgcatgtagtgaactgtttaaggcaaatcatctacactagatgaccaggaaatagagaggaaatgtaatttaatttccattttctttttagagcagtatacaaagatgctgatttgtatttattagactctccttttggatacctagatgttttaacagaaaaagaaatatttgaaaggtatgttctttgaataccttacttataatgctcatgctaaaataaaagaaagacagactgtcccatcatagattgcattttacctcttgagaaatatgttcaccattgttggtatggcagaatgtagcatggtattaactcaaatctgatctgccctactgggccaggattcaagattacttccattaaaaccttttctcaccgcctcatgct

SEQ ID NO: 228 - DNA, 350 bp, Homo sapiens
acaaaatgctaaaatacgagacatattgcaataaagtatttataaaattgatatttatatgtttttatatcttaaagctgtgtctgtaaactgatggctaacaaaactaggattttggtcacttctaaaatggaacatttaaagaaagctgacaaaatattaattttgcatgaaggtagcagctatttttatgggacattttcagaactccaaaatctacagccagactttagctcaaaactcatgggatgtgattctttcgaccaatttagtgcagaaagaagaaattcaatcctaactgagaccttacaccgtttctcattagaaggagatgctcctgtctcctggac

SEQ ID NO: 229 - DNA, 381 bp, Homo sapiens
tcatgggatgtgattctttcgaccaatttagtgcagaaagaagaaattcaatcctaactgagaccttacaccgtttctcattagaaggagatgctcctgtctcctggacagaaacaaaaaaacaatcttttaaacagactggagagtttggggaaaaaaggaagaattctattctcaatccaatcaactctatacgaaaattttccattgtgcaaaagactcccttacaaatgaatggcatcgaagaggattctgatgagcctttagagagaaggctgtccttagtaccagattctgagcagggagaggcgatactgcctcgcatcagcgtgatcagcactggccccacgcttcaggcacgaaggaggcagtctgtcctga

SEQ ID NO: 230 - DNA, 352 bp, Homo sapiens
agcctttagagagaaggctgtccttagtaccagattctgagcagggagaggcgatactgcctcgcatcagcgtgatcagcactggccccacgcttcaggcacgaaggaggcagtctgtcctgaacctgatgacacactcagttaaccaaggtcagaacattcaccgaaagacaacagcatccacacgaaaagtgtcactggcccctcaggcaaacttgactgaactggatatatattcaagaaggttatctcaagaaactggcttggaaataagtgaagaaattaacgaagaagacttaaaggtaggtatacatcgcttgggggtatttcaccccacagaatgcaattgagt

SEQ ID NO: 231 - DNA, 395 bp, Homo sapiens
aagctgtgttgctccagtagacattattctggctatagaatgacatcatacatggcatttataatgatttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcgatatattactgtccacaagagcttaatttttgtgctaatttggtgcttagtaatttttctggcagaggtaagaatgttctattgtaaagtattactggatttaaagttaaattaagatagtttggggatgtataca

SEQ ID NO: 232 - DNA, 385 bp, Homo sapiens
tgtgggcatgggaggaataggtgaagatgttagaaaaaaaatcaactgtgtcttgttccattccaggtggctgcttctttggttgtgctgtggctccttggaaagtgagtattccatgtcctattgtgtagattgtgttttatttctgttgattaaatattgtaatccactatgtttgtatgtattgtaatccactttgtttcatttctcccaagcattatggtagtggaaagataaggttttttgtttaaatgatgaccattagttgggtgaggtgacacattcctgtagtcctagctcctccacaggctgacgcaggaggatcacttgagcccaggagttcagggctgtagtgttgtatcattgtgagtagccaccgcactcc

SEQ ID NO: 233 - DNA, 359 bp, Homo sapiens
tcagtaagtaactttggctgccaaataacgatttcctatttgctttacagcactcctcttcaagacaaagggaatagtactcatagtagaaataacagctatgcagtgattatcaccagcaccagttcgtattatgtgttttacatttacgtgggagtagccgacactttgcttgctatgggattcttcagaggtctaccactggtgcatactctaatcacagtgtcgaaaattttacaccacaaaatgttacattctgttcttcaagcacctatgtcaaccctcaacacgttgaaagcaggtactttactaggtctaagaaatgaaactgctgatccaccatcaatagggcctgtggt

SEQ ID NO: 234 - DNA, 407 bp, Homo sapiens
gctaattcttatttgggttctgaatgcgtctactgtgatccaaacttagtattgaatatattgatatatctttaaaaaattagtgttttttgaggaatttgtcatcttgtatattataggtgggattcttaatagattctccaaagatatagcaattttggatgaccttctgcctcttaccatatttgacttcatccaggtatgtaaaaataagtaccgttaagtatgtctgtattattaaaaaaacaataacaaaagcaaatgtgattttgttttcattttttatttgattgagggttgaagtcctgtctattgcattaattttgtaattatccaaagccttcaaaatagacataagtttagtaaattcaataataagtcagaactgcttacctggcccaaacctg

SEQ ID NO: 235 - DNA, 375 bp, Homo sapiens
acacactttgtccactttgcaatgtgaaaatgtttactcaccaacatgttttctttgatcttacagttgttattaattgtgattggagctatagcagttgtcgcagttttacaaccctacatctttgttgcaacagtgccagtgatagtggcttttattatgttgagagcatatttcctccaaacctcacagcaactcaaacaactggaatctgaaggtatgacagtgaatgtgcgatactcatcttgtaaaaaagctataagagctatttgagattctttattgttaatctacttaaaaaaaattctgcttttaaacttttacatcatataacaataatttttttctacatgcatgtgtatataaaaggaaact

SEQ ID NO: 236 - DNA, 367 bp, Homo sapiens
agttcccatctctggtagccaagtaaaaaaagagggtaactcattaataaaataacaaatcatatctattcaaagaatggcaccagtgtgaaaaaaagctttttaaccaatgacatttgtgatatgattattctaatttagtctttttcaggtacaagatattatgaaattacattttgtgtttatgttatttgcaatgttttctatggaaatatttcacaggcaggagtccaattttcactcatcttgttacaagcttaaaaggactatggacacttcgtgccttcggacggcagccttactttgaaactctgttccacaaagctctgaatttacatactgccaactggttcttgtacctgtcaac

SEQ ID NO: 237 - DNA, 362 bp, Homo sapiens
ggacggcagccttactttgaaactctgttccacaaagctctgaatttacatactgccaactggttcttgtacctgtcaacactgcgctggttccaaatgagaatagaaatgatttttgtcatcttcttcattgctgttaccttcatttccattttaacaacaggtactatgaactcattaactttagctaagcatttaagtaaaaaattttcaatgaataaaatgctgcattctataggttatcaatttttgatatctttagagtttagtaattaacaaatttgttggtttattattgaacaagtgatttctttgaatttccattgttttattgttaaacaaataatttccttgaaatcgga

SEQ ID NO: 238 - DNA, 391 bp, Homo sapiens
aagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatgagtaatagcatgaggaagaactatataccgtatattgagcttaagaaataaaacattacagataaattgagggtcactgtgtatctgtcattaaatccttatctcttctttccttctcatagatagccactatgaagatctaatactgcagtgagcattctttcacctgt

SEQ ID NO: 239 - DNA, 386 bp, Homo sapiens
agcccgacaaataaccaagtgacaaatagcaagtgttgcattttacaagttattttttaggaagcatcaaactaattgtgaaattgtctgccattcttaaaaacaaaaatgttgttatttttatttcagatgcgatctgtgagccgagtctttaagttcattgacatgccaacagaaggtaaacctaccaagtcaaccaaaccatacaagaatggccaactctcgaaagttatgattattgagaattcacacgtgaagaaagatgacatctggccctcagggggccaaatgactgtcaaagatctcacagcaaaatacacagaaggtggaaatgccatattagagaacatttccttctcaataagtcctggccagagggtgagatt

SEQ ID NO: 240 - DNA, 373 bp, Homo sapiens
cctcagggggccaaatgactgtcaaagatctcacagcaaaatacacagaaggtggaaatgccatattagagaacatttccttctcaataagtcctggccagagggtgagatttgaacactgcttgctttgttagactgtgttcagtaagtgaatcccagtagcctgaagcaatgtgttagcagaatctatttgtaacattattattgtacagtagaatcaatattaaacacacatgttttattatatggagtcattatttttaatatgaaatttaatttgcagagtcctgaacctatataatgggtttattttaaatgtgattgtacttgcagaatatctaattaattgctaggttaataactaaagaagcca

SEQ ID NO: 241 - DNA, 397 bp, Homo sapiens
tggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcgatggtgtgtcttgggattcaataactttgcaacagtggaggaaagcctttggagtgataccacaggtgagcaaaaggacttagccagaaaaaaggcaactaaattatattttttactgctatttgatacttgtactca

SEQ ID NO: 242 - DNA, 376 bp, Homo sapiens
acttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgctaactgaaatgattttgaaaggggtaactcataccaacacaaatggctgatatagctgacatcattctacacactttgtgtgcatgtatgtgtgtgcacaactttaaaatggagtaccctaacatacctggagcaacagg

SEQ ID NO: 243 - DNA, 377 bp, Homo sapiens
gcaggtagtgggggtagagggattggtatgaaaaacataagctttcagaactcctgtgtttatttttagaatgtcaactgcttgagtgtttttaactctgtggtatctgaactatcttctctaactgcaggttgggctcagatctgtgatagaacagtttcctgggaagcttgactttgtccttgtggatgggggctgtgtcctaagccatggccacaagcagttgatgtgcttggctagatctgttctcagtaaggcgaagatcttgctgcttgatgaacccagtgctcatttggatccagtgtgagtttcagatgttctgttacttaatagcacagtgggaacagaatcattatgcctgcttcatggtgacacat

SEQ ID NO: 244 - DNA, 355 bp, Homo sapiens
ccccatggttgaaaagctgattgtggctaacgctatatcaacattatgtgaaaagaacttaaagaaataagtaatttaaagagataatagaacaatagacatattatcaaggtaaatacagatcattactgttctgtgatattatgtgtggtattttctttcttttctagaacataccaaataattagaagaactctaaaacaagcatttgctgattgcacagtaattctctgtgaacacaggatagaagcaatgctggaatgccaacaatttttggtgagtctttataactttacttaagatctcattgcccttgtaattcttgataacaatctcacatgtgatagttcctgca

SEQ ID NO: 245 - DNA, 376 bp, Homo sapiens
tgtgccagtttctgtccctgctctggtctgacctgccttctgtcccagatctcactaacagccatttccctaggtcatagaagagaacaaagtgcggcagtacgattccatccagaaactgctgaacgagaggagcctcttccggcaagccatcagcccctccgacagggtgaagctctttccccaccggaactcaagcaagtgcaagtctaagccccagattgctgctctgaaagaggagacagaagaagaggtgcaagatacaaggctttagagagcagcataaatgttgacatgggacatttgctcatggaattggagctcgtgggacagtcacctcatggaattggagctcgtggaacagttacctctgcct

SEQ ID NO: 246 - DNA, 397 bp, Homo sapiens
tcgtgggacagtcacctcatggaattggagctcgtggaacagttacctctgcctcagaaaacaaggatgaattaagtttttttttaaaaaagaaacatttggtaaggggaattgaggacactgatatgggtcttgataaatggcttcctggcaatagtcaaattgtgtgaaaggtacttcaaatccttgaagatttaccacttgtgttttgcaagccagattttcctgaaaacccttgccatgtgctagtaattggaaaggcagctctaaatgtcaatcagcctagttgatcagcttattgtctagtgaaactcgttaatttgtagtgttggagaagaactgaaatcatacttcttagggttatgattaagtaatgataactggaaacttcagcggt

SEQ ID NO: 247 - DNA, 400 bp, Homo sapiens
gaaactcgttaatttgtagtgttggagaagaactgaaatcatacttcttagggttatgattaagtaatgataactggaaacttcagcggtttatataagcttgtattcctttttctctcctctccccatgatgtttagaaacacaactatattgtttgctaagcattccaactatctcatttccaagcaagtattagaataccacaggaaccacaagactgcacatcaaaatatgccccattcaacatctagtgagcagtcaggaaagagaacttccagatcctggaaatcagggttagtattgtccaggtctaccaaaaatctcaatatttcagataatcacaatacatcccttacctgggaaagggctgttataatctttcacaggggacaggatggt

SEQ ID NO: 248 - DNA, 373 bp, Homo sapiens
tccagatcctggaaatcagggttagtattgtccaggtctaccaaaaatctcaatatttcagataatcacaatacatcccttacctgggaaagggctgttataatctttcacaggggacaggatggttcccttgatgaagaagttgatatgccttttcccaactccagaaagtgacaagctcacagacctttgaactagagtttagctggaaaagtatgttagtgcaaattgtcacaggacagcccttctttccacagaagctccaggtagagggtgtgtaagtagataggccatgggcactgtgggtagacacacatgaagtccaagcatttagatgtataggttgatggtggtatgttttcaggctagatgt

SEQ ID NO: 249 - DNA, 372 bp, Homo sapiens
ccatgggcactgtgggtagacacacatgaagtccaagcatttagatgtataggttgatggtggtatgttttcaggctagatgtatgtacttcatgctgtctacactaagagagaatgagagacacactgaagaagcaccaatcatgaattagttttatatgcttctgttttataattttgtgaagcaaaattttttctctaggaaatatttattttaataatgtttcaaacatatataacaatgctgtattttaaaagaatgattatgaattacatttgtataaaataatttttatatttgaaatattgactttttatggcactagtatttctatgaaatattatgttaaaactgggacaggggagaaccta

SEQ ID NO: 250 - DNA, 393 bp, Homo sapiens
tgaaatattgactttttatggcactagtatttctatgaaatattatgttaaaactgggacaggggagaacctagggtgatattaaccaggggccatgaatcaccttttggtctggagggaagccttggggctgatgcagttgttgcccacagctgtatgattcccagccagcacagcctcttagatgcagttctgaagaagatggtaccaccagtctgactgtttccatcaagggtacactgccttctcaactccaaactgactcttaagaagactgcattatatttattactgtaagaaaatatcacttgtcaataaaatccatacatttgtgtgaaactttgttgttttcagatgcgttcacttgtcatgtttcatcagtctctcactcca

SEQ ID NO: 251 - DNA, 407 bp, Homo sapiens
gtgacagtcacattagttcagagatattgatgttttatacaggtgtagcctgtaagagatgaagcctggtatttatagaaattgacttattttattctcatatttacatgtgcataattttccatatgccagaaaagttgaatagtatcagattccaaatctgtatggagaccaaatcaagtgaatatctgttcctcctctctttattttagctggaccagaccaattttgaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagt

SEQ ID NO: 252 - DNA, 373 bp, Homo sapiens
aggacaactaaaatatttgcacatgcaacttattggtcccactttttattcttttgcagagaatgggatagagagctggcttcaaagaaaaatcctaaactcattaatgcccttcggcgatgttttttctggagatttatgttctatggaatctttttatatttaggggtaaggatctcatttgtacattcattatgtatcacataactatattcatttttgtgattatgaaaagactacgaaatctggtgaataggtgtaaaaatataaaggatgaatccaactccaaacactaagaaaccacctaaaactctagtaaggataagtaaaaatcctttggaactaaaatgtcctggaacacgggtggcaattt

SEQ ID NO: 253 - DNA, 389 bp, Homo sapiens
agtcttgtgttgaaattctcagggtattttatgagaaataaatgaaatttaatttctctgtttttccccttttgtaggaagtcaccaaagcagtacagcctctcttactgggaagaatcatagcttcctatgacccggataacaaggaggaacgctctatcgcgatttatctaggcataggcttatgccttctctttattgtgaggacactgctcctacacccagccatttttggccttcatcacattggaatgcagatgagaatagctatgtttagtttgatttataagaaggtaatacttccttgcacaggccccatggcacatatattctgtatcgtacatgttttaatgtcataaattaggtagtgagctggtacaagtaaggga

SEQ ID NO: 254 - DNA, 400 bp, Homo sapiens
tctgcctagatgctgggaaataaaacaactagaagcatgccagtataatattgactgttgaaagaaacatttatgaacctgagaagatagtaagctagatgaatagaatataattttcattacctttacttaataatgaatgcataataactgaattagtcatattataattttacttataatatatttgtattttgtttgttgaaattatctaactttccatttttcttttagactttaaagctgtcaagccgtgttctagataaaataagtattggacaacttgttagtctcctttccaacaacctgaacaaatttgatgaagtatgtacctattgatttaatcttttaggcactattgttataaattatacaactggaaaggcggagttttcctggg

SEQ ID NO: 255 - DNA, 405 bp, Homo sapiens
ttagtgtgctcagaaccacgaagtgtttgatcatataagctccttttacttgctttctttcatatatgattgttagtttctaggggtggaagatacaatgacacctgtttttgctgtgcttttattttccagggacttgcattggcacatttcgtgtggatcgctcctttgcaagtggcactcctcatggggctaatctgggagttgttacaggcgtctgccttctgtggacttggtttcctgatagtccttgccctttttcaggctgggctagggagaatgatgatgaagtacaggtagcaacctattttcataacttgaaagttttaaaaattatgttttcaaaaagcccactttagtaaaaccaggactgctctatgcatagaacagtgatcttcagtgtca

SEQ ID NO: 256 - DNA, 398 bp, Homo sapiens
gcgtctggcacataggaggcatttaccaaacagtagttattatttttgttaccatctatttgataataaaataatgcccatctgttgaataaaagaaatatgacttaaaaccttgagcagttcttaatagataatttgacttgtttttactattagattgattgattgattgattgattgatttacagagatcagagagctgggaagatcagtgaaagacttgtgattacctcagaaatgattgaaaatatccaatctgttaaggcatactgctgggaagaagcaatggaaaaaatgattgaaaacttaagacagtaagttgttccaataatttcaatattgttagtaattctgtccttaattttttaaaaatatgtttatcatggtagacttccacc

SEQ ID NO: 257 - DNA, 400 bp, Homo sapiens
accatgctcagatcttccattccaagatccctgatatttgaaaaataaaataacatcctgaattttattgttattgttttttatagaacagaactgaaactgactcggaaggcagcctatgtgagatacttcaatagctcagccttcttcttctcagggttctttgtggtgtttttatctgtgcttccctatgcactaatcaaaggaatcatcctccggaaaatattcaccaccatctcattctgcattgttctgcgcatggcggtcactcggcaatttccctgggctgtacaaacatggtatgactctcttggagcaataaacaaaatacaggtaatgtaccataatgctgcattatatactatgatttaaataatcagtcaatagatcagttctaatg

SEQ ID NO: 258 - DNA, 368 bp, Homo sapiens
aagatgtagcacaatgagagtataaagtagatgtaataatgcattaatgctattctgattctataatatgtttttgctctcttttataaataggatttcttacaaaagcaagaatataagacattggaatataacttaacgactacagaagtagtgatggagaatgtaacagccttctgggaggaggtcagaatttttaaaaaattgtttgctctaaacacctaactgttttcttctttgtgaatatggatttcatcctaatggcgaataaaattagaatgatgatataactggtagaactggaaggaggatcactcacttattttctagattaagaagtagaggaatggccaggtgctcatggttgt

SEQ ID NO: 259 - DNA, 391 bp, Homo sapiens
acagagtgtggggaagaaactgtgtacattttgatgggatccattatgtagctcttgcatactgtcttcaaaaataagttacactataaaggttgttttagacttttaaagttttgccattggtttttaaaaaaatttttaaattggctttaaaaatttcttaattgtgtgctgaatacaattttctttattacagaagtaccaacaattacatgtataaacagagaatcctatgtacttgagatataagtaaggttactatcaatcacacctgaaaaatttaaatgttatgaagaaattatctcatttctattaatatgggaactgtgtcttcatctttattactgttctaaggtcaactcaatgtagattttacttgcttatggtttca

SEQ ID NO: 260 - DNA, 353 bp, Homo sapiens
agtagttgaatcattcagtgggtataagcagcatattctcaatactatgtttcattaataattaatagagatatatgaacacataaaagattcaattataatcaccttgtggatctaaatttcagttgacttgtcatcttgatttctggagaccacaaggtaatgaaaaataattacaagagtcttccatctgttgcagtattaaaatggcgagtaagacaccctgaaaggaaatgttctattcatggtacaatgcaattacagctagcaccaaattcaacactgtttaactttcaacatattattttgatttatcttgatccaacattctcagggaggaggtgcattgaagt

SEQ ID NO: 261 - DNA, 400 bp, Homo sapiens
gccccgatcaccaaatgcaaacattcatgattcagtatattttcatcttgactgccaaagttgatctgtttcttaatatattacatctagacttggaactggagatgagaacagaatattatcttcctcatttttgtgtttttgttcaactctaatgtctgcaaagcacttgcgtatgtaatgatgctcagtgtcataggagcaggcaggtaagtgtaaatttgtctggataggagaaagcatgcacaacatatttcacatagttttctgatttcagtttgtttttgcaaattattcactcagtgagatagcttaaagacgttatcacagggaaaggcatggagatagttctgtgttgatagaaaacttgtaatgtacagccatgagtgagaagtcaggt

SEQ ID NO: 262 - DNA, 364 bp, Homo sapiens
tgcttggcttcctttcggtggattagtcaagatgttttgctgactgagactaggaaatctataggagggcgggttagtttacattgttccttgtcattatcgctaaaacactccaaagccttccttaaaaatgcgcactgggctaaaaaggatagacaaggaacacatcctgggccggtaattacgcaaagcattatctcctcttacctccttgcagatttttttttctctttcagtacgtgtcctaagatttctgtgccacccttggagttcactcacctaaacctgaaactaataaagcttggttcttttctccgacacgcaaaggaagcgctaaggtaaatgcatcagacccacactgccg

SEQ ID NO: 263 - DNA, 394 bp, Homo sapiens
cctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggt

SEQ ID NO: 264 - DNA, 400 bp, Homo sapiens
tgggccggtaattacgcaaagcattatctcctcttacctccttgcagatttttttttctctttcagtacgtgtcctaagatttctgtgccacccttggagttcactcacctaaacctgaaactaataaagcttggttcttttctccgacacgcaaaggaagcgctaaggtaaatgcatcagacccacactgccgcggaacttttcggctctctaaggctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaag

SEQ ID NO: 265 - DNA, 397 bp, Homo sapiens
cggaacttttcggctctctaaggctgtattttgatatacgaaaggcacattttccttcccttttcaaaatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcg

SEQ ID NO: 266 - DNA, 398 bp, Homo sapiens
aacacacaacaaagcttcctgaattgatttttgttgggaaaattactgggattaacaatctgtgacttttctcacagagtgattttcactaagcaattgaaattttgaattttaataggctttacttgttcactactttataaggaatacatttatattattctcttcacttttccttttccctattctttttctccttttctctccagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggtaaatgatgtcaataaacctgttcagttggtgatgagaaacgcagggct

SEQ ID NO: 267 - DNA, 364 bp, Homo sapiens
agccacacttgacattcattgttacagaaggaatttcttcctgtttcttattcctttaggggattatgcatgagagcaaacccttcttcgctgtgcagttccacccagaggtcaccccggggccaatagacactgaggtacgtcaaaaagatgaggcctattatgtatgcaaaaaaaaaatgtatttgtgtggaaattcgagaaaccaaaataatcaccccagatgatcttgagcagaacattctcaagaagagtgctttggtaacacacattttgtattaaaatctccccatgaatgtcacagaggaaatttttatcttttttaaaatttaaagtgggaaagcccttaagaaacccgaagcga

SEQ ID NO: 268 - DNA, 432 bp, Homo sapiens
aaaacttggcattctcagaaggtatctgatatgtttactgcttgttggaaacttcttttttataagacttgaagtgaacagaagtgtttatttgattaaattctcacactaacagatatttagttattgacaaaaaagcaaaaaaagctgaaatgctataataaaaattatttgttgcttatctgaagttcaaatttaactgggtatattgtgttttatctggtgaacttaggaattttgaagcttctaactagttggttgtatttttttctagtacctgtttgattcctttttctcactgataaagaaaggaaaagctaccaccattacatcagtcttaccgaagccagcactagttgcatctcgggttgaggtcagtatgtgggcttatttttggtttatgaattttggattgtccctatcacatgaaga

SEQ ID NO: 269 - DNA, 364 bp, Homo sapiens
tgccttatttcccccattttagcagtaataacagtgtctttttcttattgcttataggtttccaaagtccttattctaggatcaggaggtctgtccattggtcaggctggagaatttgattactcaggatctcaagctgtaaaagccatgaaggtgagagaatatgatccttactagaattaatatgcttcctttaatgagtctaattagtattttataatttagatttatgacactacctcttttcaaagttgctataattattttccttaactgtgcctttataaatcttgtattaaagaagcttgatcacgagcaagaatttcaactttctgtaatgtgcacatctgtaaattgaggaggt

SEQ ID NO: 270 - DNA, 424 bp, Homo sapiens
acctaaaagcttagttaccccatgtctttttatttaagtgtggtcattctcttctttagaccatatattcatgtactggattcttttgtttctttcaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggtgagttcttataagcttaattgcagagttttgacatatgcactgctgtgtaatgtattttatttgagctcatctaacaattgtgctttgtgtgttcataaaacctttcctctactgtgtgagaaagcagttagca

SEQ ID NO: 271 - DNA, 370 bp, Homo sapiens
attttgtcagaccgtcttcagaatttttatttcaatttttttccctaagtgcaattctattgtagacagtggtaacttctcggattttaagattaaaaaagtagttgtattcagttgtctattaaaaaaggcacaaaattcaagattttaaaaactaatcctatttggttcttctttaggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcggtaaggattctttgctttggaaaaacaagggca

SEQ ID NO: 272 - DNA, 371 bp, Homo sapiens
tgttctgccagtgtgctcagcttttaaaatgttgagtccttgttcttgttgacagattgaggatgcactgaaggcagcagacaccattggctacccagtgatgatccgttccgcctatgcactgggtgggttaggctcaggcatctgtcccaacagagagactttgatggacctcagcacaaaggtatgtatttttgtagacaatattcttaccaaccaaaaaaactggcttgatagaccttttcaactagagaaagttatgtagatgagaaattacattttctttattaaatcatgatcatgttctccaaaagcgtattccaaaagatgacacttttgcgagagcatgcagtgcaactcttcatgccagg

SEQ ID NO: 273 - DNA, 449 bp, Homo sapiens
tcagcactttgaatggcaagcctcaataatgtaaatcaagcatattcactgcaggatgctattcctagtacctcactgattttctgacacattgtgccttctgtgcaggggagaatggagacggggtttgagagttcagtgctgaccaggatttatgccagggtattttgccaaatatccttgttgaagccagtgctttttcttactctttgatatcttttgtcaccaatttctaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtaggcaaagtatcttcaagaactatagtaatgctttcagttcatgtctttgatggccaaggcagtct

SEQ ID NO: 274 - DNA, 408 bp, Homo sapiens
tgggcaaaacaggaattgggggaatacctgatatcacatatatatcccaacaaaccctcagactgttctatgtcttgcatcgtgcaagtagatggttaagtcgctgaagttggttatttcaatatgccaccaagtaatgagtgcttcttggatatataggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactgggtaagaccagaataattgaccatgggtttgcagattct

SEQ ID NO: 275 - DNA, 450 bp, Homo sapiens
attctcctgtgacctgtgcctctatactttgtatcatgactcctattattccgcaagtggctactaaatattgatgcagaacagagaatcaagtgtcttataccctgaagtagaataataccagaaattttaagaaagaccaatttatgttttggtctgttttcaataattgctcgaagaaaaaaaaataaatttgtcttctttttatagctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtgagtccttggtttattacgcttttcttcttgttctcagt

SEQ ID NO: 276 - DNA, 446 bp, Homo sapiens
tgcaatttgtgttacatgcccatggaacatctctggacattacctcaggaggaggggttaagagaaggaggagctgtggctgaagacatttaatggcagaatgaatggaaattcaaagatcgctgtgcagtcagccttaaacactgactgcacccctcccagatttcttttacattaactaaaaagtcttatcacacaatctcataaaatttatgtaatttcatttaattttagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggtaatacccatattgattgtttctgataaaatactatggggtatagtttagcagtgaagcaaaggtgtccc

SEQ ID NO: 277 - DNA, 418 bp, Homo sapiens
aggaaagcaactggaaatctgggcattatggtttcattaaatatactgtgcctttatttaatatgtctgtgtattttacctttggaatatttttgtgtgttttgtattatgtattctgctaagattcatgcaactgtttcttcaggcacagacagcacacattgtcctggaagatggaactaagatgaaaggttactcctttggccatccatcctctgttgctggtgaagtggtttttaatactggcctgggagggtgagtaatgcttttccaaggctttatttttcctctagtagagaaataactggaagatctcactcatggtggtaagttgaaatcactgcatcgtagtaagactacgtattgtcctgaagttgcaccatgccttgtgcatagcctactgctgccgtccttgaaa

SEQ ID NO: 278 - DNA, 450 bp, Homo sapiens
agctgaactccctgagtggtaaaagactgacctaatgaagatgcattataccaaaaccatggagaaagtgagagaggaagaaaaaaaggaacacctttttttttttttaatttgagaggctttatgatatattttttgttcttatttgttttataaaatatattttacgtccagttcagttacaaattaaagatacataagctctttctttcaatatgaggtcttaaacatgtattacaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggtaagatgttacaaggggcccacagctactagt

SEQ ID NO: 279 - DNA, 395 bp, Homo sapiens
cacaccactcaaggcaagcacctactctgtatgccatttgtggatatagttggcaccatctttatgtttattggaaggaatgtcagtgatgtcagtttcatgttttgtaactcagtctacagtctcgggctctctaaataacacacagaggcatgactgctatgtattttaaaccaaataagacatttagaaaaatgtttgccaaagaaagtatctcttctcctcttggcaggccattgatgacaacatgtcccttgatgagattgagaagctcacatacattgacaagtggtttttgtataagatgcgtgatattttaaacatggaaaagacactgaaaggcctcaacaggtaaggcagtgctgctctcattcatgccagacaccttcagtgca

SEQ ID NO: 280 - DNA, 429 bp, Homo sapiens
gcagcagggaagaggtcgcatagagtgtgaaagcaggagatcagagattgtcagctttgcaaatagaagacttcatagaggctagaagattgagtgggttagttatttgtgtatttttaaaagataacaagacttaaatatgtttgaaggtggaaaataagaagcccttggtgttcttgaaattgaacttgtcaccgctttttattgtttttggtctaaacttgaatctctcttttctattaaatcctagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacaggtaaaggagtttcccttttcccccatcccccactgac

SEQ ID NO: 281 - DNA, 421 bp, Homo sapiens
tgcttttagagagctggtggggtaagtcttcctagtaaccagttgactataggaccactttgcgatgttcatgagagttactattactactagtgatccaatgccctgtttctcaggtgataactagaccacatcactattttctctctcttattttcagaattagaaagcaattccacgggtcatacattttcctgtttgcatactttacagtaataggaattaaaggaatatgtatataaagcacaaaaaatttagtcttgaaaaaattataataacattcttatttgtttattttatttgttttctcttacagattgatacactggctgcagaatacccatcagtaacaaactatctctatgttacctacaatggtcaggtaggaatgggcaaattggcctatccagaaagctctaga

SEQ ID NO: 282 - DNA, 387 bp, Homo sapiens
tgatttctgcatcttccttttcttatttcctcaggagcatgatgtcaattttgatgaccatggaatgatggtgctaggctgtggtccatatcacattggtaaaataataaattatgtgtatataggactttacacaatttatatagttttcttcatacatgttaattccattattccaagaactatatcaaataaatgctgtaatatatgttttgcaaattaggaagctggggttcagaaaaataaaacccaaatatatacagctatttagtggtagagtgggactcaaatgcaggtctcaactacaaattctatctcctctcatttcactgtgtaacttaattttcatcctttttaactgaattgagcctttcactggagttggga

SEQ ID NO: 283 - DNA, 410 bp, Homo sapiens
gcttccttagcctggactgactggtgatacatttctgcttctctttgtattgtaacttcgtgcttctcttatcccttttgccaatctcattgtctctgcaggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggtaagaaaagaaaaacagaaaaaaaagaaaaaagaagacagatatatgtagtatacactttatatatatgcattctggtatatagatgtatatagtaattcctcttagaagaaagggctgccagtgg

SEQ ID NO: 284 - DNA, 449 bp, Homo sapiens
ttagcatctaagtgccagaaagtaaaaattttgtggcatcatttaacagtattcattggtaggagagatgtaaatatcacagtcaggttaagaattatcagtaaggaaatagacacaatattagcatagttgtccattcataatgaagttattccaatggctgatattgtgagtgtattttccaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttggtaaggagagaaacaagtatctgtttctaatgttctattttgaagagctgcaacctgaatgttgactga

SEQ ID NO: 285 - DNA, 364 bp, Homo sapiens
aagctgggctaccactcgagctaatgatacattctgtaattttattgcatattttaaactactcatacatttttattgttgtttctattaattagaatgaagcactggaatttgcaaagtctgtggactacccctgcttgttgaggccttcctatgttttgaggtaacactgtatattgttttccaaaacaatgattcaaaaattgggagatacagaaatgcatgctgtatgctaatagcactagggttctatatgtagtaatttataaatccattaacaatttccaaaccatcacagccagtttaaggaccaatgtgtggtcttctagtttaatgctttcccttcagggagtggccataggaa

SEQ ID NO: 286 - DNA, 449 bp, Homo sapiens
aggcaccttcttattcagccccgactggaactataggttgtctggaactgttctgagaaccagtcaagtctagtattagcataaacctgacctgctttttttccccttccttttccagtgggtctgctatgaatgtggtattctctgaggatgagatgaaaaaattcctagaagaggcgactagagtttctcaggtagtgtccaatttctttgtagtgactgttatctcttaataaacatgtagtgacatttatctcttaataaaatgtagtgacatttatctcttaatgcaaccttactttgtatgttttcttttcacacaatgtgttagaatgagttttcttttttcctcttctaccctctagtctcctaaaagaatgagaaaccttgaaggcattaaattataactagacttttaaggttggtggaaaaagaggaatacctgtgca

SEQ ID NO: 287 - DNA, 423 bp, Homo sapiens
tctgcttcctccttagtcccctcttttctctaattgacctggatgcctatacttgaggattcagaactcatggtcagtttgctgagcactcaaagttggagaaagaccctctgcctcactacaagcaaagaacaaccttgttcttacagcacagattaggtaatgagtttatgtagttatgttcagccttgagtattttgcaagtattgccctgatacttataatacttaaagtacatggcttattgacactatatacatagcgttagctaaatgttcggctcctctgttttccttcgtgacaggagcacccagtggtgctgacaaaatttgttgaaggggcccgagaagtagaaatggacgctgttggcaaagatggaagggtaagtgctttattctcatctccttcattcctgccttctca

SEQ ID NO: 288 - DNA, 393 bp, Homo sapiens
tgtcataacatttccccaggtacgttaaaatctagagacattcttgttggattcttctcattttcaagggttaaataattcagagcatgtatgcagattatagctttgtagttacatacattatttgctgataattttttggcatgtttacccaggtacccagaagctattactgaccctgcctacaaaggacagattctcacaatggccaaccctattattgggaatggtggagctcctgatactactgctctggatgaactgggacttagcaaatatttggagtctaatggaatcaaggtagtaccagtggtggccatttaaaaagtctcaatttgagggagtatagttgacttattcttaagaattaggatggccaaactttcttcctca

SEQ ID NO: 289 - DNA, 353 bp, Homo sapiens
ggaccaaaggggaggatgagggagtagcttccttgaaggaagtacctgaaaactttttctaaaatcctttttttttttttttggccaggttatctctcatgccatctctgaacatgttgaagatgcaggtgtccactcgggagatgccactctgatgctgcccacacaaaccatcagccaaggggccattgaaaaggtcatcatttataaataaaagtggaagggaaaaggcaacactcagaaaaaaacacctaaggttttttttttttttttaaagctaggtagcaatgtaagatatgctgcaggttaaatttaatgatgaggctaacttccttgctctgagtcacctgggt

SEQ ID NO: 290 - DNA, 384 bp, Homo sapiens
aggggaatttggcagagagataatcgtgtacaattatttgttcttttcctattattttgtgtgtatttattgcatattattttgttaatagaaacctaatagtgccctccattataattattaatgtagatatatagctgtctgtgaagagaaattaaagacatccaaatttaaggtactgtgccttttagaaagttttcaaaaactaagatatgctctttagcacactatacgattatgctttttaattcaggtgaaggatgctacccggaagattgcaaaggcttttgccatctctggtccattcaacgtccaatttcttgtcaaaggaaatgatgtcttggtaagaaatgccaaggtgcctgagaggacaccaccactgtg

SEQ ID NO: 291 - DNA, 415 bp, Homo sapiens
agcaaaacaagagctggtccccagttaataacagctggaaaccagtggtagagagaatattaatattgttgttactggctctcaatgtcctctttctcattttgaattttatctcttcaggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggtaacattttcaaaaatttattagtcattttatgagttctagtgaaattaaaagaacaatttgtcatcaaaaatcttgttacttttaaaaccttctaactaaagggttggactagggatttaca

SEQ ID NO: 292 - DNA, 358 bp, Homo sapiens
ttcaagtcggatgcttggacccaagagattttttacatgtctactgtagcctaagtgaactctgtgagagatgatttgctaatatatttatcctctcttattcattttctacttttccctcacataatttttctccctgttttttttttttccaacaggctcccatgttttcctggccccggttgagggatgctgaccccattctgagatgtgagatggcttccactggagaggtaactagttaataatccatggaagctttcattaaatctactttgaaatctatggttttatgatttgaatacagtaaaataaagggaataaaaacatctgctatcagagtaagactcaaagagct

SEQ ID NO: 293 - DNA, 396 bp, Homo sapiens
aagatacatctgccctggccagccttttaatccctggattcagattgcacaggctttgggcaacattaataaaatctacagaaggagtctatgagtaaagtactttccatttgtgcgtgcatgtgtgtgtgtgtgtgtgtgtgtgtgtgtattttaattttaatttttggtaggagtggttgactattctttgcatcctctattttaattttttatttatttctaaacaggtggcttgctttggtgaaggtattcatacagccttcctaaaggcaatgctttccacaggatttaagataccccagaaaggcatcctgataggcatccaggtaagtggtttgtggctgtgtgcttgcccatggtcatacatggtgagtggggaggggcaggatagaa

SEQ ID NO: 294 - DNA, 418 bp, Homo sapiens
aggatccttgtagaaccgaagtggatctgaacttacaaagaccaagtagattaaatagagaataaaaggagataagaacaaggtgaaaagcagggatcaagattatgtggatggaatttcattgacattgggatatagctaaaactcacactcaccatagaaggataaaaggataaaacttgtcattttttaatataaagcatccggcaacatgtaacattgtcttttaagatgttgtaaggaaataccatattgcataaatgaagagcatgtatatctagaaagtgaattttgtgaaattccttttcagcaatcattccggccaagattccttggtgtggctgaacaattacacaatgaaggtttcaaggtatgttcattagttttaagttgttttctgtcagcatggaatctgtcc

SEQ ID NO: 295 - DNA, 431 bp, Homo sapiens
aaagtgcccatgcctctggactgtgagtccaagtctctatccatggcactatactacttctcatgttcagcaatttcttcttctttatgttttaaattacatgttccataaaaataagaaatcactgtgatacggtaattgattttttcattttaaatgcagctgtttgccacggaagccacatcagactggctcaacgccaacaatgtccctgccaccccagtggcatggccgtctcaagaaggacagaatcccagcctctcttccatcagaaagtaagaactaggcatactgttttctgaaataatttagaggattaactttgagaaccagtatatgaatatttcaccttacttgattgcaagtcttttaaaacaaatttaaaaatgaatacatttgtggatgattgtcaagtttcactctccatcact

SEQ ID NO: 296 - DNA, 446 bp, Homo sapiens
atggcagtcaactcagcatggcattgacttgaatggctaagagagcaatttatgttagtattttataaactaactataaaatatgccttgttgtctataagtttttgtttatttttccagattgattagagatggcagcattgacctagtgattaaccttcccaacaacaacactaaatttgtccatgataattatgtgattcggaggacagctgttgatagtggaatccctctcctcactaattttcaggtatagtcttttccttggatatagactggatgggagttttatttctgtgcctcccttaagagtgtaatcagtagatgcacatctctcttttcccctctttgtaactttcagaatagagaggaatttttaataatctaaaataatgatgctaacatggtaggtcatggcttaaatgggacagttggtgatcaagcaa

SEQ ID NO: 297 - DNA, 392 bp, Homo sapiens
atggagggtgctgattcctaccattatattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaactgattcacaactttctcagagatgaatattgataactaaacttcatttcagtttactttgttatgccttaatattctgtgtcttttgcaattaaattgtcagtcacttcttcaaaaccttacagtccttcctaagttactcttcatgagatttcatccatttactaatactgtatttttggtggactaggcttgcct

SEQ ID NO: 298 - DNA, 442 bp, Homo sapiens
tgttcatcatgtgcattaagccagtaattattaattaaattcttgataaatgccatgcatgtcagaagggggacctagtttagtctcaggatttaccaagccaggtaagcctgctccctctcaggataattaatgcaacaattacatattttaaaagaagggcattgatttttttttttttgcctcttgtttttaaaaatcctaagtctcatgtcagtggatatcataaaacttaaaaacaaatgcaaattgactcacaagagttggataatatcttgtgataacctctttaaaatgactgtctgtctttctaggtttcaggtttgctggtgctggattatagtaaagactacaaccactggctggctaccaagagtttagggcaatggctacaggaagaaaaggtaagaaatgtaatagggcatccatcatcacctaagga

SEQ ID NO: 299 - DNA, 449 bp, Homo sapiens
ccctgggtcagagaaaagaaagagtggagaaattatttactgctcaagaagatagatgaggccaagtttgtaacttgaaaacaatatgctggatttaatctcctccaatttcactgtcactacaatttttttcttataggttcctgcaatttatggagtggacacaagaatgctgactaaaataattcgggataaggtataatcatcatctttagccaaatctatgtttcttcgggtgtgtgtgtgtgtgtgtgtgtgtggtgtttccctcagtgcctaagggatccattaatatgtaaaggagtgaatctggccagcttctgctatctgggtctctgttattttgttttactattttcactgtaattttcaagattgaatacttgattggtatgtttttaactgaatggacttgagattcattcacctggcagcttattgagtgccca

SEQ ID NO: 300 - DNA, 450 bp, Homo sapiens
catcaggcaatggtgtcagccctagaagaactaattgtatttccaagagtatttcccaaaatgtatgtgcaaattgcttaatcttttcagtttgagaagatgaagatcttccatgatggttacgagtagttataaagacatctaagtcttgcagcagctgtttaaagtccctgtgagtttatcttgtcaacacctttatcgttgcttccttttaactgtctaatttttttaatttgatagggtaccatgcttgggaagattgaatttgaaggtcagcctgtggattttgtggatccaaataaacagaatttgattgctgaggtttcaaccaaggtgaggggttttcctttatattttgtagttttatttgatcccatttagaccttcttgaaatatcaaaatctttatttaggcagagtttatcttccagaagcaccagtgttcaggggt

SEQ ID NO: 301 - DNA, 381 bp, Homo sapiens
tttggtctgttgcccatagctgggacttccctctcattctctggtttttaaaatggcaggatgtcaaagtgtacggcaaaggaaaccccacaaaagtggtagctgtagactgtgggattaaaaacaatgtaatccgcctgctagtaaaggtaagtaatttgttcatttcaaaggtgagggtttgtcatattgaccattagtgttcagctaatttcctctgtcacagagaaacttatgcattctttcagaatgtcaggggtctacattcttcttgttgcttttgatttacaaaataacacatttatccctgttcaaattaaaaatatagactgctatgttttttctttaaaaaaaaaacctcaagggccactaaaacatgga

SEQ ID NO: 302 - DNA, 354 bp, Homo sapiens
tggttagtcaagagaaagtctagcaaaattatactttggcaaagaaacatgttattaaattcatcattcttgtgtctcttttccagcgaggagctgaagtgcacttagttccctggaaccatgatttcaccaagatggagtatgatgggattttgatcgcgggaggaccggggaacccagctcttgcagaaccactaattcagaatgtcagaaaggtgcaatgaaccttgaattcatgtgtatctgtgtgggaggtgggggcttccgctctataccctcaaagggctgtgatacattttatttattcaggcatttttcaatgctggtatttgtgacttctgaggcagtgtcagt

SEQ ID NO: 303 - DNA, 445 bp, Homo sapiens
accttgggacccataagacctgcaggtctctaaagaaatattaaattagatttagtttagtttgaatgtaaagtacatcttaatgaattataatgctacaaatttgtcaattatgtccttttttatattcttctttaattcagttactattctctttaccttcttaagaaaaaaggatacctcatttttgttcattcagaagcaacattttttggaactgtactaattggttaataaaaattctccctgatttagattttggagagtgatcgcaaggagccattgtttggaatcagtacaggaaacttaataacaggattggctgctggtgccaaaacctacaagatgtccatggccaacaggtgaggtattttcacttttgcttacagtaaaccagctctgacatactaactaaatacaaagaactcagagcacttacctgcca

SEQ ID NO: 304 - DNA, 360 bp, Homo sapiens
actccctccctccttggcctaagtttgtccttctgaggctgccatcccaaactctactcctaatccctccccacacccaggtttgctcttttaaaatagttgctttcttaggaaatgtagttgctttcttaacctcatcaaattcatgaagatttagccgaggcccatggtgagtcttaagctggatatctctcatgttttaaaagatgggtgtttgaaggagcaactcacaagagagaaaaggaaaacgagagacattttatcaattattttttctttaatgattaaaggctatccatttatcccactcacagtctttaagcaattaaatattactgttgttaagcaaggcaggatggt

SEQ ID NO: 305 - DNA, 449 bp, Homo sapiens
cccattgctcttgagacctgccaagccgggagaccccagagaaaaacagagccgaggtggggagtcccgtgccaggattcccacaggccctggtggggatgggccccagtgaggaagagcgcctccaccaccccccaaaacaggacaagggacctaggctgcgcacctgtctcctgcggtgagggctgccagcctggcctccccgggctgaggctccgaggtattgtccaggatcctctgcatctgctgctccatctcccggggcttcagcagccgcccatcatggtagagccagaccttgaagtagcgtcctcgatggtacacgacgatgtgcttgctgtctctcatgtgctggatggtgtctgagccggccgcaggttggagacacaaaaccaagagtcccaagttcagcacgtgctgagacgaccgtaccctgactctgcaaaggg

SEQ ID NO: 306 - DNA, 414 bp, Homo sapiens
tccaagctcatgggcaaactcctgtctctcagaaggtaaggacggtacctgtcgtaacatcggccgtgtagtagagatttggcgtagctgtccattgacgtatccgggtcttcacttctgtatccttcttcagtttcatctaacgtcacaaagaacgctgctttctccacagcatcaagagactgcttatttttcccacgtccaaaataggcctgacgacacctggcccagggaactctgcagtgaagatgaaatacgattaaaggcagcccgacctgcagcgatggagcgtgatgtttgaaatgacacaatcaaacctttgcagtttttcagaatttctcgaaggaaaactccatgttgatgatgttccccatctgagactgtttgctggaaggactctcacctgctcctggt

SEQ ID NO: 307 - DNA, 379 bp, Homo sapiens
aagcaacttccacattcaagtgaaaagtgtgaaaactcacctcccaaaggtgggccacgatcggcgcatctgcccaggagtgttcagcgttgaggcccatcttcccgtttttgaagacaacaaacgtgaacgacttgtcaaaccacctacgtgaaacacacatgtgtggaacttaagtgtttaaagaggcaacaatgaggagacattgcacctctctgcttcatcctggatggactaattcactttgcacctgtccctctaacagtgagcagacactcagtctctgtggagtgagggtgaaagtacaaacaggacactgaatcactcatttcttccctgtcccagacacaaagatgagcgcttatatcctggcagcctg

SEQ ID NO: 308 - DNA, 414 bp, Homo sapiens
ccacggaactccctgagcaaacaactttcagcctcagtggtcttcaactgagctcatgatagggcaggaactacggttggaaaattcatctgtaagacttcaaatgtgtttcccatcccaggtaagtaacaatggttggataatccggacttacttcccccgggatgtcccactgcagcctggtggggtacggaatgttcggattgatgtcgcctttgcagtgcccatcctccgcatagcccagctggaggctgtcaatggacatgacgtactgtcaaaaatagaacaaaattattaaaactaacagtggtacataaaacacattaacctccaacatgaagagagggttgttctttgcagagatgttacaaagtttgaatcacagctgttaaggcttccagtatgctcagcacc

SEQ ID NO: 309 - DNA, 382 bp, Homo sapiens
ggtgaacagtcttgggcaggtgtaggaacccccaaagtgctcacgacaaaaccctaggcggtcagttcttaccttgtagtgcgccagctggagggccagctgcacaaaggcgtctgggctcgtgcgacatttcttgatgattcctttaccaaaggctacgaatgggaaggaatggaaatccacgtcgtttgccagaagatttgcggtgttcagggaggtctctataacctcttgacacttgagagaaagaagaaaaaggttttacggaacgaggggagaaaagtactgacgcacacccagaaggaaattggaggctggtttttagtgcagctataaactcggtactgggaagtacacaaacgttttcctgacccagaagccc

SEQ ID NO: 310 - DNA, 383 bp, Homo sapiens
acatgcgtctctgtccttgtccctacctttaccttttaatattttaataccttctgtacccttgaaaggggcagaggaaagaagctgaattgagcacccctaaagaagaaggtacaggaatgatgagatcagagaagctggagtgatggcctccagaagccttttagggaagtgtgacaagcacgttgtgtcctcagcctgatggcacattaccgtctgggccgggtccaccatggcccgcacgaagtcgcatgactcagtggtgcaggagcgcacggtctccgtcctcccctctcggaagagccgggtcatggaggcctcgtatgtgaggcaaaacttgcccatgtcctggggaaagagaagtacttcagtgcacggcaggg

SEQ ID NO: 311 - DNA, 359 bp, Homo sapiens
tgcagtactaaacgcgctgctcacattttccattttatgacagctacacccacagacccgtttttttcaaatgcccattctgacattaaaatatgttcatgcaaggctgtagtaatttactaagttttggtctagccaatacaactgacggaagaagtggaagagacttacttccttaaggaaaggggactccacagcgagatatttagacaccacgtaaaggcagaagaggtgacgatcgatcccagagccggtcatggcgaggcgatacatatgctgatgcttctcagacgccaacttgaacaacttcagcctctgttccacctgagtgacaaaaggtgggaaggacatatgttgca

SEQ ID NO: 312 - DNA, 408 bp, Homo sapiens
attacccatcccatcaccacgccccactgcgcctcgcccagccccgccgcactcaccggtccaaagccccctccgctggacacgtactctgggttattctccaagtcaaacagctccacttgctgctgaggggtctggcttgttgataatctccaaggctcagataaaacctattgagtgaaacagggaaatgtttcctaatcccctcctctaccgtccctcaggagtcgctttgggaagacgagaaaagcctggcttggtcttttgattgttccacacaccacaagtctatgtctccaaaggcctcactggcttgggcagcgtatctgcagagagcatgcggggtgggtggggcccccagactggggcagggagtgcagggtgggggtgggggcataccagcaaata

SEQ ID NO: 313 - DNA, 436 bp, Homo sapiens
aactcaacaagatttgcatcccttaataaatccaagccgatgcggagacatcaggggagactttatcagatgtcccccaagggagggcaagtctggaagtagtggggttatgcttcacaggggagagatactgttctaggaaaaaaaaacacccacattttctggaaggaaaactgagtttttttaagagcagtgtttcatcccgagctaaggtcaggattaatgcctatttttcatttggtttgcatcagaagagctcgttttccttcccagcagctccagtggaattactttttggaattagaactgagaccaaacaaagtgatgatgtcagtcattgcttctttcaggtgccttccaaagcgatgagaatcctttcatgtaaaaacaaaaaccaaaaacctattaaaacgtggccatccccacatttcaagct

SEQ ID NO: 314 - DNA, 437 bp, Homo sapiens
gacctcaatagcagccagagccccgttcttagatattaaaaggcatactgtgtagatttcaacaaatctcagaaaaccttgaatctgatgaacttctttttccaggaatgaagtccagagagatagatttgtctaagagcttcatggctcagccgcaggtcaatcccgtccggagtgaccgtgaactgaaaggccacagcttggtgagcttctgccatcttcagagagtacctggaaggagaaggagaaaatgtaacacagtggaacgtgtgaccagacactaaaaaaccctcatacagaagtgccattccttctgaacttaagttcttcctcgccacttaacagatttaatacttttcatcaacagaccaattccatcaccacagctggcacccccttgcctgtccaccgctacaaagacagtcgccacctctgct

SEQ ID NO: 315 - DNA, 450 bp, Homo sapiens
acagcacccaggagacaggaagaaagctgacgtgagaacagcatcaggagcttcatatggaatccagaacagtgacaatcatcacatttgaagagacataaaaacagcaataaaatcggtaacttcccagacaattggagatttcacaggattacttacgccgtttccagagtccgattgatttttgcaattattcctaacgaggggtcgatcttggcgtacatcgttgtcatcacgcccaccaccacgataagccaactggaggggcttgccgggtacacgccagtgatgatgccgttctaaagacagacacccgggccgtgagcggtgtcctcccacaacccacagggcaatgacgcttcatggcccctggcagcagggctgctgggacagcaggcagtgagaagagggtgtggacagcgtgcgtgcactgagaaaccacaccccact

SEQ ID NO: 316 - DNA, 442 bp, Homo sapiens
ttacagcaatgtgagaatggcctaatacaggtgctcaagaaaaacagaaaaatggaattcatgcattacttttaacatatttattgagcatcttttatgtgtcaggcactgttctcagcattgaggcaatggaatggatgaataaatgcacagcaagtgaaaatcaacaggcttttctttccagcccagcacatgaacttggtgatgtccatggtctcctccaaggccttgtttccatatgctgagactttccactttgtctcaagtatctgaacttggtccttgacttataatccccttaatataacaaaagagacagaaacaaatcttgtagtagactggggttaatgttttattaatgataacctacattcacactgcatttctaagatttacatccaaagagcatactgtatttacatgcaccggtcagcccaagata

SEQ ID NO: 317 - DNA, 442 bp, Homo sapiens
caaggttgaggcccaagtcaccaaccaagcatagagggagaaaaggtcgcaggggtgtccttccgcaggggtgtccttcttcccaaagcccaaactgtccaccccctccacagccagagggacacgcaattaccatccagatcttggtggcacgactcatcttgccgtgctcagtgaacatccacccgtggtaggagagcagcactttcagggagtagcgcatggtgacgatgagggccacccacaggccggtgccaaacagcacgccgctgaccacgttcttcgtctggctggacatgcagttgctgtggagacagacccagacaagggaggctgtgcgtgaggccacacggtgccaccaacaccaccggtgacgccacagacaccacgtgctgcagggtccagcagcctgccccaggtacagccgggaaagtcagaggga

SEQ ID NO: 318 - DNA, 399 bp, Homo sapiens
gcacaccgctgaaggctacttgagccaaatggcggtgacctagttcatcataattaagacctaagccttaatccacagatggctggcatttcagtgtgaggcctaagccacacctaccctgttcacagtgtctttgacagccgggaccggcaggcgaggcagcgatgtctggaagctgtacaacatgggttttcggcctgaaaagatcttgaccataccctgaagagagagaattatattttcagactactgccatactactctgaaggcacctgttctcgtctgatctcgtgaagctaagcagggtcagtcctggttagtacttggatgggagaatgaccatttcaaagacaaggctatgttaaagatccgaagccacttttcccgtgcgcacaatgt

SEQ ID NO: 319 - DNA, 381 bp, Homo sapiens
acacacacactccactctgcacagaggtaaaactatagctggaacttcctagggtgtgattttggctaatccaaactgtcatttcagccctgttatccctgcccctcaaaattagcgtcttcatacggaaaaatttcatcaagaaaaactgtgtatacagacttacgtaatttgtagcccaccaggattttaacttcaaataccactgtaatcttggtccaagaccgacagcaaaatcttgagcaagtgctgtcatccgtttgaagtcttcttccttcataagaggcctcaccgactgtagatactgggattattgggggaaaaaaaaatcacccaagttaaaacatattaatcaaagcctatgtttgcctcacttgtgcc

SEQ ID NO: 320 - DNA, 416 bp, Homo sapiens
aacccaaatccccctgcagtagcagagcaccctgggctactaggctaacactgaagggtactcatagggttctccggcctggaagcaggacagagaggagcatgagccaatccccagagttttcccaggccgtccacaggcctgtgaagacgccacctctgtggacagacccgccgccccaccgtcctcgtcagacagcagcccgggcgggtggactcaccatggcataatagttgctgttcaccatgagcggccctcgtcctcggaggtagatgtactcctcccaccagtcgctcacctagtgggcgcaaacaccagacaaacccgcaggctcagcaggggccaggcaggctccctggcagcagcccagagccgcggggaagggcaggcagtgcttttggcagacatttcggcgt

SEQ ID NO: 321 - DNA, 364 bp, Homo sapiens
tgagacagttggcagtcttcaaccaaagagaaattaaaatctggaaataagtcaacaacagtgtccaggcctaagacagacaaaggaaattcagcagaaggaatgttcaccagcctacaatctcaggaagggtcagcaaaaatcaatttggcccctttgacacttcctaattctgagcatagggatggaaagtgccgattctccagggggccctgaagaagcttgactcacctgtctcctctcctgggatccgggaagtattaaacatccgctcccactgagcggagcagagtggaatcgtggatcccaaaagacgaatctgtaacaaaaatatatttcaaaccaacaacgaaaatcccacaga

SEQ ID NO: 322 - DNA, 424 bp, Homo sapiens
tatgttccccatatgcactgtgcaagaattaagagacgatatccgtaaagcccatgtaaataggcattcgatccgtatagtaactttttattaattaatgacaatagggcaacttagaaaatatgctgagaaacattccgataattgtttctgagaacccgagaaatgttctgagaaagaaagtggaaaattacgaaaccaagccattccgtaaaaactactaaaacagagtaatttaagctcctcagtaagcttaaacatcacagaaatgtgatgaagtacgttcactccacgaatatttatcaagtcctcttaagcactgctcagtggggatgcacagtgacagctgatcaaggcagatcgtctagtgaggaagacaaataaatgcatgattaaaaataggacaagctaccaggagcagtgg

SEQ ID NO: 323 - DNA, 419 bp, Homo sapiens
ctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggtgagcctggcctccgggtccccgccgcccgccgccgtcccaggatcggccccaacctgactg

SEQ ID NO: 324 - DNA, 413 bp, Homo sapiens
acaggaattcttggggcagcttctgcttccccattttgaatctattattgttatttaaaataattatatttgtattttacttaaagatttagttgttattttacttaaaagtagagttaccattgatatacttggcattagtaaacccattgattctgatttgtcagtcgcttctgattattggttttgggggaggaaattaatgatctagtaatcagttcattagcttgtaaagctaattaacctcttccatatactgtcagccttacactgaccctgctttctccccaggctgcctattcccaaacttgaagacaccattaggagatacctcagtgcacagaagcctctcttgaatgatggccagttcaggtaaacactgagaaccttgggtgagcatagttggggtggtt

SEQ ID NO: 325 - DNA, 441 bp, Homo sapiens
aggttttagggctatgctgttggggacccaaaactctattatgagttcctcgccatgaacctaaaaatcatgtattccctaccatggtttgattttgtcttttcttgaatgttttaggaaaacagaacaattttgcaagagttttgaaaatgggattggaaaagaactgcatgagcagctggttgctctggacaaacagaataaacatacaagctacatttcgggtaggtaggctgggctgtgggtatgatttctcccagagccctccataatgaaaagtaaggcatattctctcctgttttggtctcagagatatttttggtgagaccagcaaatgaagtaacgtctcatcctcccttcctgaggtaaattaaggctgagtgtgttcctcctctactgaggtgttgacttgagcccatgctcaagaatgatggccagcct

SEQ ID NO: 326 - DNA, 450 bp, Homo sapiens
tgccatttcctttgtctatgcttgaattttttttcttcttcaaattttatttttagggacagcattaacattttatgttatttttttctttttattttttaggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaaccca

SEQ ID NO: 327 - DNA, 445 bp, Homo sapiens
tggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaa

SEQ ID NO: 328 - DNA, 415 bp, Homo sapiens
cctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccgtccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggc

SEQ ID NO: 329 - DNA, 418 bp, Homo sapiens
actggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggtgaggcaggggtggggagcatgcccttgggtcttgtcctcagtg

SEQ ID NO: 330 - DNA, 444 bp, Homo sapiens
tcctgaggtccttttccatcctgagactctggttttccattttgtttctcacaggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccggg

SEQ ID NO: 331 - DNA, 363 bp, Homo sapiens
agtccctgaatttgcttaaactccatttttcagttatctaatacatgtaccttaattgatccaagggccccaatggctacttcaggtggcattatcactggtttggcaaaggtaccaccaatctattttttaaaaaaaaaaaaaggagagtattaaaagttaagatttttcagggaacaaatgccaagtgacttttctatttttaattaagcatatgatcagaaaccttaagtaatggtttatgtatttcaacattattactcactgatccaatgttggaaagagtaaatgttcctcctgtaagatcagtggtgctgagctgactcacagagcccaatttctggaggcggttcagttcagtgg

SEQ ID NO: 332 - DNA, 448 bp, Homo sapiens
tggcacagctagggtttacatactctttggaagctcaaaaagttcaagaatgtcttatcagtcttcatttcagatctagtagcataaaagctgggttttctaaataggatttccacaaattggagaagcgtgacattgtagcaccatcaataactctgtgatcagctgaccagctcacattcattatctgtgccttatatacttctcctttctggttaaatcggggaatggcctagaaatgaaaaaaaaaaaaaaaaaaaaaaaaaaaagaacaaagagtaaaccttcacttgttcagagctcaagctctaacaatggtgtaagatcaggcaaacccttcttcctgtacagtacagaaaaaaatgggcatccccaatgacttttgaaaatgctgattcctactcttcccatctttgagtatatgcctggagcttacagaagttctcca

SEQ ID NO: 333 - DNA, 356 bp, Homo sapiens
tgccagtttcaagccattgacacaaaaacatcagcaccatattaagaagtcacactctgacctataaaatgtgacagccccaggagaaccattacaccattattcattttcagtaaaaagtctaatagaacagtgacaaatattgtgccttagatccttaatcatacgatacaaatcatttacaatataaattgtaaagatgaacatgtgctggcacagctagggtttacatactctttggaagctcaaaaagttcaagaatgtcttatcagtcttcatttcagatctagtagcataaaagctgggttttctaaataggatttccacaaattggagaagcgtgacattgtagcacc

SEQ ID NO: 334 - DNA, 425 bp, Homo sapiens
gtacagatggagcaggacggctgagtcgctgcagaagcgcttccaggtaaggggagggagtgggtttccactccagactggtcgactcgctccgttctctgccctttattttgcatgcatcccttcacctctccatcacgcgtgccctggacgcctggcaccggaggagaaagtaaaacaccactcctggatgactccggacaaatcactccttcccggcctcagatctgcccaaacgtgcttaccagcttccccgcattcctgctccaggttctcagcatacggactgcagccatcttaccccggaaatgacaacagtgccgcaaactggagagactctcctcggcgcggcctatcaggagatgggaaacgcgcctccccctgggcgaccaatagggagggaagaaacgagcctcccacccaac

SEQ ID NO: 335 - DNA, 394 bp, Homo sapiens
aggggtgccagtgttaaggaaagtatgtaaaagagagggatgagaaaaaagaaagtgagaactggaaaaatgtggggagatgggaagggcccggctagaaatacagagtcaacttttttttgtttaaaaagtctcaatcaactactaaaaaatattactgaatgaggtacaaaacattattttatacacgttattttgaaatcatacttaccagcagttgttttcaggaagtgatgtggatgactatacttgaatgaaggataaccaaagaaacacacataatttggcttcaaaacatgaacattaccacatgtttgaaaatagcgaacacaaatctacagatgagaaaacaaaaagtaaaagcatttataaacaaccataccggcttatctct

SEQ ID NO: 336 - DNA, 430 bp, Homo sapiens
agagagcttagactacctgacagttttaaatcacactaaataaagtaccttgatgtatgacaaagtccttcaccactatatcatcaacacaaggtaattctaccttattgcttttaaaaatgcattatgtgtttataaagacgtttctcaatttaaatggattcccactatccattaaataaataaaaataaaaatagttatttttactcaaattatttttaaatttacttaagagcttttttcagattcacttaccattctttaacagttacttctctaatcccttctccaatgtctgagagcttgaactgaacaacctgtccacggagagcttcaaagacaaatgagaaatgatctcattaagtatataacatattactaatatatactttcacatctaaaattagagaatgttctcaggcagaggca

SEQ ID NO: 337 - DNA, 374 bp, Homo sapiens
tgggacccaatgacaaaaagagaccaataatcaatttggtaaaatagattaacagacttacaataccttttaaagcttccgtttctatgtctactaatggcttccccacataggcaatatcgtctagattataatagagttttttaatgactccatcataacgactagtgatggtaacagaagctttatcactttgaacttcacagatgctatcaaactgagacactgtatctccttcttttacatacctaaaagaaaaagaaatgagacacttttatggaaacagtcataagtacagatcatattaaggatgtaaatgccatgctgagttagatcagtattcatctagcccagcatttactttcagatggtgt

SEQ ID NO: 338 - DNA, 433 bp, Homo sapiens
agctatttcatcatgggatagttggctaatttttcagagatacaaatgtacacttcctatacaatctcagacttaaatattaagagaacttacattgttttccattgccagacggcgaactgcaggagttgccagtgtttttcggccctttatctcttggtgtgtatgttcatcatgagacactgcaggagtttcaacaacatcttcttctgaatctggtaacaaggtaaaacttaacttcagttgaaaaaaaattttttttttttactaagatgtaaagtaaggccactaagatgtggcctataatatctaaataaattaaagtttatagtctaaatgtataaaagttgaactacttcagaataggaaaacacaactatcctaatggtatgggtagagtgggggggggggtgtgtgccggtacctggtactt

SEQ ID NO: 339 - DNA, 372 bp, Homo sapiens
tctactgaggtagcttcccccaaaataaatgaactattgccttatagtattgttattattatcattaccttttatgggttctgttttgtctttgcctgtgaataccggaggttttgatactagtataggaacagtcatgtcttttggctttggtggaggtggcataatttcaactttgggtgaaggaggcaatatagctcctgtctgcttttccaaatagttgaggatatcttctttaagtattctgccatcttttcctgagccaacaacttcactcagcttaatctaaaaaatgatatattttaatgccaaaaatacaactatttaaaaacatcattaaagtttcaaaatggaatttgatcaactgacagt

SEQ ID NO: 340 - DNA, 416 bp, Homo sapiens
tgtcctactcaagccttgtttgaaatgaatgaatctcacctttaagaagaaaggcataaaggagagtttaattccacgagcaaatgcaatgggttttaattcttctcggagcttaaccagttcagtaaggtcaatctcatcacaataaccaaaatgaggtatcttcagggctgcagacatagtcttgaccattgctttttgaaagcctgaaaagcattaaattgttattcatttatttaaattctcaaatctcttcatccttttttttttttttaaagaaactaaaatggaaggttctctaatgtcttttactctctcagttaaacccttcctcttactactctcttcattacattacactgaaagtcactaatttcaaagctggaacactgactgcatcatgacactcagtggca

SEQ ID NO: 341 - DNA, 450 bp, Homo sapiens
cccaaggaagcagcctgtttaacagaaaaagaatgcaattttagtacttttaacttagaaaggatagagaatttgaaacaataagaggtataaaaggagggagagagagaactcttatttatgctgagtttaatttcaagtctacatgtacctagtcacattactgccaatgttaccttcaggccatgtggaactaggtcaccctaatcattaaagaataaaagataaagtagtcaggtagcttgtaaacatcaaggagattttcaaaataatgatacagaccagccaaagttccaaagaaaatgtctaaattctaggtgatttcctcactgacatgttgatcttaagatttccatgagaagtaatactaggaatcaaaacacaaaaaaagcaggtaagctatttctctgtgtggaaagaacacgtaacgaggatttcaaagcgcactga

SEQ ID NO: 342 - DNA, 450 bp, Homo sapiens
gggtaacataatctgccatacagctatgtatttccattattttaagcaggaaaaaaaaaagcttaaaaatagttttaagaatctctaaacagtattattaacacaaaaacaacaacaatgaattagacttaagtttaatgttttaccccatacctttaattctagtctaaaaaagatcactatttgaggtacaatagaagtctctaatctacaagcacatttgccccatcttctattaataataagaacatttttactctgcatagccaaccttatatgttatattctggcagttttcatccacagaagcgttaaggataggaaactgtagtaatcccaaggaagcagcctgtttaacagaaaaagaatgcaattttagtacttttaacttagaaaggatagagaatttgaaacaataagaggtataaaaggagggagagagagaactct

SEQ ID NO: 343 - DNA, 449 bp, Homo sapiens
actggtttggcaaaggtaccaccaatctattttttaaaaaaaaaaaaaggagagtattaaaagttaagatttttcagggaacaaatgccaagtgacttttctatttttaattaagcatatgatcagaaaccttaagtaatggtttatgtatttcaacattattactcactgatccaatgttggaaagagtaaatgttcctcctgtaagatcagtggtgctgagctgactcacagagcccaatttctggaggcggttcagttcagtggcgatgtcaaatatagagcagatctgaacatttttcacattagggacaatcaaaccctgctcagtatccattgctatcccaatgttatgagaagcctaaaaaataaaaaattgtacagtagggcttttaatgaataagctaacagcaaagaaaggatcaaccttcactgccatctagaaacca

SEQ ID NO: 344 - DNA, 367 bp, Homo sapiens
ttttgaagagctgcatttgatgtattttttggtgacttgtttactggaaacttttgttaccataatgtaactgaaggtaagtagctgtgatttcagaaattcattgtgtttcttttgatttctgtggtagtatctatgccattggtgatgtagttgctggtccaatgctggctcacaaagcagaggatgaaggcattatctgtgttgaaggaatggctggtggtgctgtgcacattgactacaattgtgtgccatcagtgatttacacacaccctgaagttgcttgggttggcaaatcagaagagcagttgaaagaagaggtaagtctgaacatgggtggttttaagccaatgtgtgagttgtgcca

SEQ ID NO: 345 - DNA, 352 bp, Homo sapiens
tgtgctttgcgaacaattcccttcttgggatttattttctgaacaaatggtagatgattttacaaattggaaagaacttttctggcagttacgtagattctttttttctgactgtcacagggtattgagtacaaagttgggaaattcccatttgctgctaacagcagagctaagacaaatgctgacacagatggcatggtgaagatccttgggcagaaatcgacagacagagtactgggagcacatattcttggaccagtgagtattgtaaaaccagagaaatcccattaagatttctagaaagcattgctgtttattaattataaaccacctggtgttagtctgaggttgc

SEQ ID NO: 346 - DNA, 392 bp, Homo sapiens
aaagcttcccctcaacaattgctatcctattagcatgtagtttttgccttggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcaca

SEQ ID NO: 347 - DNA, 429 bp, Homo sapiens
ttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtga

SEQ ID NO: 348 - DNA, 440 bp, Homo sapiens
agagcttgttgaacttgtcacgctttactgtcgataatgtgcattaagcaaacgctagttttatttgtttatttcatcttctaagtataagaatacattgtagctcgacattttggcaccagcccctaaagcattcccaccaccacccccgctgcgacaaagccctgcgctccttacgacagcgtacgacgccgagcctgacaggaacgcctcgtgcggtagaaccgcgcgggccaatcgcgctgctcccgggtgatgacgtaggctgcgcctgtgcatgcgcagggaggggagaccttggcggagcggcggaggcgcccagcggaggtgaaagtattggcggaaaggaaaatacagcggaaaaatgcagagctggagtcgtgtgtactgctccttggccaaggtgagggccgagtaggtgaggtcgtgttgagccagag

SEQ ID NO: 349 - DNA, 450 bp, Homo sapiens
tcatatcttacataatagggacattttctttttctagagaggccatttcaatcgaatatctcatggcctacagggactttctgcagtgcctctgagaacttacgcagatcagccgagtaagtacttaagtaaaacatttttttcatcacattagctgacagttcctttctatttcaatgtaaaagcaagtgaatattggaataacttatgttaagtgtcttatagttcatttgttcatgtatttattcgtttgaatgtatattgagctagtgtgttccaggcggtgaacaaggtaaaaaaaccctgctcttatgaaacttgtaatttggtgataaaagacaaacaatatataagtaatggataaatattttgggaagtaactgaaaattaaagcaggtaatagggaggaagagagataattttagatacagtgtcaggaaaggcctttct

SEQ ID NO: 350 - DNA, 396 bp, Homo sapiens
tcgggttatttgtttgctcttccaaagagctctttttggtaaatattaagcaatttactattttatatcaatttgcttttatcgtagttgatgctgatgtaacagttataggttctggtcctggaggatatgttgctgctattaaagctgcccagttaggcttcaaggtaaggtttgaactcaaactaagtattgatttattttaatttgggaagggttgatcatatttataaagtactttgcaggcaaaaacatggtaaatacttccttaactctataaattacttgtaagcctgagactaataaagattaggttcatttggttgtagtattctcttggaatggaaagtgaaatctattagttttcttctcttcccagtacttttcattttggca

SEQ ID NO: 351 - DNA, 394 bp, Homo sapiens
agtctgtgaaaacatagcccgaatagcttgttttgtagaagaattaagacatatatttggaattttagtgatctgaaacattgaggttatgtgcagttaaataatgttttctttggttgtagacagtctgcattgagaaaaatgaaacacttggtggaacatgcttgaatgttggttgtattccttctaaggtgagcatgtgttttgtacagcacagagattgtttttggctagcaaccaactagaaggatggattgagactagattagacaaatacacttgttaaaaaacaatccaagttgtggcacatttcacacagagaaaaaaaagaatgataaaaaacacacttctcttttgtaaaacttaaagagtgctgtcactagtctgccacaca

SEQ ID NO: 352 - DNA, 409 bp, Homo sapiens
agtgctttttgattatttgaagtctgtttatgaatatttgataatttgatctttttaatttcctttaggctttattgaacaactctcattattaccatatggcccatggaaaagattttgcatctagaggaattgaaagtaagtatacttttcatgcttaatgatattaccagactgcttgacttggctcttctgtctaaagacttaaatgtgtctaacgtacgcataatagatgtttagtgaaggaagagtaaaataaataatctaaaaaatgtggagagatttacttaaaaaagaaggcctaaatccagatttctcccagccaagtataaccaagcctaaccctgcaaatccagatttctaccattatatcttctgttcctttgccaactttttcctgaggtttgcc

SEQ ID NO: 353 - DNA, 419 bp, Homo sapiens
tgcaccatggtgtagcattactaagtaaggaagcattttgttttagataaattatttacagagtaatttttcctttgaatgatttatcaaacaaattactttaaactttgtgaatttataaagattattttgtaaaggttgttcatgtcaatggatatggaaagataactggcaaaaatcaagtcactgctacgaaagctgatggcggcactcaggttattgatacaaagaacattcttatagccacgggttcagaagttactccttttcctggaatcacggtatttatgcttcataatttacaaccattacaacttttctttagaaatacgttttataagttatttatgctatttgtgaactttgagagatttctgactgaaatactatattttgatggtcattcagctttgggaagt

SEQ ID NO: 354 - DNA, 444 bp, Homo sapiens
gctgatggcggcactcaggttattgatacaaagaacattcttatagccacgggttcagaagttactccttttcctggaatcacggtatttatgcttcataatttacaaccattacaacttttctttagaaatacgttttataagttatttatgctatttgtgaactttgagagatttctgactgaaatactatattttgatggtcattcagctttgggaagttacctgtctttattctgcagtgattctgaccagctatagaacactttatattaagatatgtttgaatacagtatgaagttaaaattgaccattgcgtttggaatattggtggataaaatttaaagtcagtgtttttaatgggatttgatgaaattaggtatatagatacctcaaaacaaataaatgacttagtatttttagtgattctactgagatcacagt

SEQ ID NO: 355 - DNA, 400 bp, Homo sapiens
tggagggtcgactgtactaggttttttcaaattattttgattatatcttttgtttttcttacagatagatgaagatacaatagtgtcatctacaggtgctttatctttaaaaaaagttccagaaaagatggttgttattggtgcaggagtaataggtgtagaattggtaagtgttgtctttctgcctcttattacctccttggagttggaagggacttaaaggtcccctttttgattttttgtataacattacaggctgatcagcattgagttttgcttaaacacttctagtaataaagagtttacttttgtttttttcaagacaacctatttatgtatttactcatttagaatgttctcctttattttagtctgtttccttgtaccttccacccttcca

SEQ ID NO: 356 - DNA, 380 bp, Homo sapiens
acctcggagcttctcataggaacatactagcgaaagaagaaaatgttttacaataaattattaagatgatttcgtaaacatttgctatagaaacttttatgattattgggtttttttaatttatttgcagggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttcgtaagtatacatcatttgtttttgatgtatcatccctgtctctttaagcaaaacactca

SEQ ID NO: 357 - DNA, 372 bp, Homo sapiens
tcaacacttgagaaattgctggccttaaatttctaagcctatcaatttatgtaggtgtgtatttaacatttatacactgtttgttatctagtattgaagctgcttctggtggtaaagctgaagttatcacttgtgatgtactcttggtttgcattggccgacgaccctttactaagaatttgggactagaagagctgggaattgaactagatcccagaggtagaattccagtcaataccagatttcaaactaaaattccaaagtaagttggataattgtctgcattttcagtaattttaaaattgatttcaaacagtattttgaaaagtaagatttttatgcttaaaatatgtattggctttggggaagaat

SEQ ID NO: 358 - DNA, 450 bp, Homo sapiens
agtcgtgtgtactgctccttggccaaggtgagggccgagtaggtgaggtcgtgttgagccagaggcacggaaggtcccgctcagtgggtccggtacgcggcttaaccgtgttgggctggcggaggcgggcgcctgggccgcaccacccctggccccgcctctgcactggctcagcccggccctgggctccgaggtggccgctcatcctgcagcaggcgagggacggggctgggcccaggctgtggcgagtcctttcgggttgtgtgacggccggcggtcacacatgccacacccccaagcctgggccgagggccatcccggtcacacataggcctctaccttggaggaagtgtaagccacccatgtcccgtatagtctggctttttataccatttgcctttttctcatcctaattctgatccctgagtggcctaagtttatgcagtgggc

SEQ ID NO: 359 - DNA, 427 bp, Homo sapiens
tggactgcctttttacccaaggtagacattttatagtgtttgataggttctgtttctgtgatacaatgatgttggccttttgtcaactataattataagttattacattttgaaactttaatactgccttttataagcattaggttgaaattttccagttggtgagtgaaaaacactgcatattgcttcaagaatttagctaagaactaaagattaattgaacaaattacagtgtccgaagttcgcttgaatttagacaagatgatggagcagaagagtactgcagtaaaagctttaacaggtggaattgcccacttattcaaacagaataaggtcagtgtttaatattcagatttctgctttactttgaatacaaattaaactttgcattatagagtgatgatatttgaacttggttacaggggaa

SEQ ID NO: 360 - DNA, 450 bp, Homo sapiens
tcaatgtgaacttataaatctgagttgataaaatgctgcttttatcaatgttttatttgatgtaatatgacttaatttgataaaatgttccactgctttaaaatacttgaataataagctggatttaagaactgctgggcattttactaggatcaagaactacacagaccttgtgaaaatgacatattcaccatggtactggctaactgctcaggaacactgagtaaggtaaatcactgagatcactgttcaacaaatacatacagtacttatccccataacattttacacagcatattttattgcaatacttactggtgctactatttttcccgtctgtccaacttgcatgtcattgggaacaaagccagcatcaacagcagcacgggaagcaccaactaaggggaaaaaatatttgtcatttttttcaagctctattattcagctagt

SEQ ID NO: 361 - DNA, 397 bp, Homo sapiens
gcagacagcactcatcatgcattaagttagcagtggagctataactcaggttcaggcctctttccatgacacagcactgcctctgtgaccaataatttttaaggcagtgaacggtagcttttatttctttcagttcccagatctacgttagtgtgaatggcttgactacatgcattgtaactacatggaaacatacaaggtaagccaaatcctaaaatgtggaaacgttttcttttaacatcactgatgtacaattaccttgctgtctttcatcccagctaaatgttggatggctccagatattccaacagcaatataaagttcctgaaataaaagaggtcacattattaatatgtatttatattatataatactttccaaagtgtttgctgttagc

SEQ ID NO: 362 - DNA, 368 bp, Homo sapiens
agcttcatccctaaccatttctgagagtttctcggatgacaatctagataatagcaatttctctcaaggccagcttaccttaaataaatctgcaactattccataatctgccacttggaaaattggagcttctgggtctttattaattgccacaattgtctgtgaaataaaaacaaagagtttgacttttaccaagaaaacatttcacacagactgatagttctattttaacttccaatatattaatattcttaaaatgtctaccaaataagatttgaggcatctgtgtcaacactgtaaatttattagaaatttccaggttggaatgtaataaaattctctcttacccacatctagcccatctcagt

SEQ ID NO: 363 - DNA, 439 bp, Homo sapiens
acagcaaggggaaatggcctgagttggctcccattttaaaaaggattaattactaacccttagtcgtggcagtgcagtggctgcaactggagcttccagtgtagagctgctttgtgactgcttggacagaggagagctgtccaagggggctgcagggaatgtcacacagatactctgaaaactggtccagccacttgtgcaaagtatcaattacccagtcttccaaggggctttcggctgccttagctcacaaagattccagctgaactcaccactgatgaatacagcctctcaattatttaagagagctacatttccattaggtggaaataatgtgttcgtacaaaatttattaaggaaattgtcgacatgttgtttcttccgaatgtcactgtctccagcctattaaaaggcccatgtttaccatggagccagcagg

SEQ ID NO: 364 - DNA, 422 bp, Homo sapiens
tcaattttctctagaggctaggcatatttctgatagttttaaagctgtggaaaagctttattatagattttagtacagaatttaaaaagttcaaacaataattgtttggaaccacaaataattaaaaggaaacacagcaatcccataaacaagcattctggcatctgttagaaattttccctcaaattatgaaatgtagctctccatgctttccaatgattgttataatacccacaaatatctgtgatttcagtggaatactttaacaaaagttttctttttaaggcatgatcctgattcattttttcttcaatatctcagtcatttcaggaactacctgcaaataaaaacaaaaagtaattaagcaactagagccttcactgtgatatggtcacagctccgtaagcattacagggaggcca

SEQ ID NO: 365 - DNA, 429 bp, Homo sapiens
gccccagaactttggacccaagtcccaggcggggaccggcctgcgggcgcgagggctggtcgaatctgagggggccagtgatctttgcaagaccccatagggacggcgggttgacggggggccgtccctgggttcgccttcccagtccggactcaccgcccgccggagctgccccggagccgccgctcggaacatggtctccgcttccgccgcaacctcggccttacagcagccccgtgcccggccaactggcgccgcctcagccagtcacctaatgctcgcgagacgcgcgaacgagataagacgccctaggccgggagcacgagcccgcggtttccgcctgcccattgggcggctgcgcagccaatagacggcgggaagttaggggctagactgggaagtggggcaaaggtgaggctattccccggg

SEQ ID NO: 366 - DNA, 435 bp, Homo sapiens
cacatgatggtgccagtggaactaaatcaagtattctactgcatttcaaaagataaaatgcttagggaagaaaccttttagttcctttttcacacatggtaatggttgtgacactgaccatttaatgaggattagagcccagtttgggttacaatcctaagcataattctctgttgccatcttttcctgtctcttgatggagataatatttgctatggctgaccttaaaaatttctcaccttgtcacatttggttccagctactaagcaggacacttcacctccaaggcgtgtggctgcagtaatggtatttaaagtaatgggtgctagggaatcatttgcatgctcagctattaccagggtactctgaaatcgtagcaatgaggcctaaaaagagcaaaaaggaaaaaaaaaggtaaagaatgttgtcacaggg

SEQ ID NO: 367 - DNA, 446 bp, Homo sapiens
tcaagcagtgatatcagattccacattctcaaccttctcacctttccgaaggcagatgctccagcacagatgtgtgtgtaattgaactgcttctgagttgccaaaatcaatggtgtcagttcctctgagaattaaacacatttgataaaaaaatattttgaaatactttcatattcatatattcaagcgtaatttagacactacatttttttctactggaaaacctcacctggaagtaggcctttgtacacatcatgctgagccaccagaacttttgctatgcctgctactttacagagatcttgtgccacctatgattaaaagataagttcctaattatccatctatcagaaatatacaaataaagccaccactataaatatcaacagatcataaaatcttaatggccaactgtaaaaattattcttattagcaaaagggccagt

SEQ ID NO: 368 - DNA, 410 bp, Homo sapiens
tgtcaagggccaccagcaattctagactaaaattttcctcagaaacctttaagatggtccacttaaagcaattgtatggtttgatttaaaattctatcttcaagattaatttatgcttttcactaaaatttaacatgttgattaattatcttccttgagtactcacctgcataaatagttctcacaaatgtgtcaggtgacttgattgcaatgatgtcagaaatcggggcaacctcaagtttggctgctactctgggcaaaaggttctaaaagcaaaataagcagtgagttaacacacatacatagtgatggaagactataaatgatcagtaatgacatattctaaatgcatattctgtagaaattttaattcaaatattttatatttcgtgtgcacctttggatacaca

SEQ ID NO: 369 - DNA, 400 bp, Homo sapiens
tcctctgtctcccactcccttgatctaccaaagcaactatcctagtaccaaagataatgtgaaaaagatgtaagttatacatatttattatttttgtataagcttgggaatatcatttaaattgaactttcaaatactattcattagaaatgtaggcagaggtcatctcttattataatacagtctatgaattaaaaaagtaagaaacaaaacaaaaaaactccaaatgaacactcacccttttctgaactggcactaccgccacttgttgctgcagcatcaaaggatgttccacggacagaaaacactttcactttctcatcacacttcactgtacatagagcatttcctgaaacatacaatctatttcttaaaagcaacagcaaaaggcaacaaaact

SEQ ID NO: 370 - DNA, 448 bp, Homo sapiens
ggtgccagtgactaggtgtgcaacagaaaccccaaactgtgtattatgctcataatttcattttcctaattggttaaatgggaataatatcccaaacttcccaacttcttacatttgaaaaagatctgtgtacttctaaaataaatactaaaaataaaaaaaaaaatcaaagtattttcaatttacatcttttaagattaatatttcacttaccaccagataccaccactttggcacctgttagctctggtcgatcactttttgttaatttctggtcaagccactctgatatttccactggtgaagtacttgatgctgcatacattaatacataataaaacaatgactatgatttcaagttctataacaagaattattttcaagagaaacacacaagtatataattccacgaaatttaagttaattactgtgaattttcagtgctcct

SEQ ID NO: 371 - DNA, 379 bp, Homo sapiens
aggccttctcctcactgaatgctatataccatttacttggaggcttaagaaaaactggttcagagagaaaaactgaaaaatccggaaaagtaaaataatttgtagggctgaaagacttacacaaaaatgaaataatgaagaaaaaatatttccaacaaaaagggaatatctttctactaaggaaaataactttacctgcagcatgtagttgatctgccaagtcatataacaacttaaagttctctccactcttcaagcctcgacctcatttaaaaagatgaaaaaaaaaaattaggcaaacatcaaatacattctggaacaattttgctattttatatactggagtaaattttcatattatgtaactgccatattaagc

SEQ ID NO: 372 - DNA, 434 bp, Homo sapiens
aaagagaacatggccgtgaccccggagggatcggatgttagaacttcactcttggatttttgccctcaggtgactttgacgtttgggggttaaagcggcagaggtcgggggttacgagaagacccccacccagtgtgcgctcgtggccccggaagcacacggctgcgggactcagggatgtgggagaggggggcccgatcaccttcacggcgtagtcgatgaccctcttgacagctacgagcacgcgcagctccgccatcttcccgccgcagccacttacagggtcagcccgcaccctcagcggctcagtccagaagccccaccacccccgccccccgcgcccctctctgcgcctgcgcgcagcacggtcagccagtcaaccgctgcagagcccgcctccccgacagaggaccaatcgagaggccggaaggaag

SEQ ID NO: 373 - DNA, 450 bp, Homo sapiens
gagtttgtaggcaggggcaggtcaccctgtctccttctctcatccagccattcctgggtaccagggacatctgacttgatcatccctactgttgtcactgctcctctcaggcctgaaagagtgtttctcaaatttacagtatttatggtaacccacagtgagaggtacattttactgtatctccaagtgtatataaatacataatacactgatacataaatacaaatgaggagaagaaaaggaaaaaccagttaggtagacagttaagggtggtcctcagaggagcagcctgcctgaaaaatcacagctacaggcaacaatagagcagcctggggaaaactcaagctgcccagcacagaagccttttgttctttgcgtgactgacaggctcccaggaaaagttccctccccttttcaggcacgtacatggtggtctctgtgggaacttgc

SEQ ID NO: 374 - DNA, 444 bp, Homo sapiens
tccgtcagacccaggagtccagccccctccccaagaccttcatcacctggcactgtgcaggcccacagctgacggcgatgacctccttcaccagcttcttctccttgagccgcacagcctcctccaccgcgatctcacagaaggggttcatggagtgcttcacaccatccgtgaccacaccggtcctgtcaggcttcactcggatctgcccagcaggaggggaaggggtggggtcaggaggaaacaggcaagaaggtgggggcctcagcgccaaccctctcccaggctggatgaggacaacgacagcctggaaaggggcagggccttgtccggggtcacacagctccagggacagaactgggttagagtttgtaggcaggggcaggtcaccctgtctccttctctcatccagccattcctgggtaccagggacatctgacttga

SEQ ID NO: 375 - DNA, 370 bp, Homo sapiens
actctgtcctccctgctcaaactctctgtcagaagggtcagcaaagtcccaagctgctcagcctggagtggtgaatgccctgggcctggccagctgctgtctcaccccgtatctccaccaccctcctcccgagcagggatgagcaagggggcacagggagggctgaccacagctacctgtttgcccagcagcaccaggtccaccttctccttctctgccagcttggccaggacccgagccacctgcaggggacccaagcgttctgcttctgctgggggcacctccacgtggatacctcggtctgcacccatggccagggcggtacgaatcgtctcctgccaaggacagaggggcttgacttggctgctat

SEQ ID NO: 376 - DNA, 450 bp, Homo sapiens
aagcagcccccatgaactctcagtattggcagagatgacccagcaaactctctctatcagccaaactccaggtgacggcttcctgtgcacgagacctcctttggatccttccctccccacgtgcgaccaccggggggcactgggctggcaatgtgcttgccacccccaggccctcagtgcccgctggccaggggctcaccatgatgttgggcagcgtggcgtagcggggctcgttgagcctcaggtcagctgtcaccacagctggcagcttcaggcgcagggtctccaggcccccatcgatctcccgctccactttcaacttgtccccctccagcgtcacctgggaggcgaatgtgccctggggagggacagtgtaggaggagagtgggtgaggctaattcaggtccgacccgagcagtctgcttatgccactactgagtacacgcatgg

SEQ ID NO: 377 - DNA, 422 bp, Homo sapiens
ttgtcctcattgtcccccgcatcaatacagaggctcctcatgggcagggactggatccacagggcctggcacacaaaagactcaagtaaatgttgaatgaaccaaataatgggtctctaggaaataagttaacagagatagatgttgagagtcagttttattgccatctctgggaggggctcaaatccgcccaatctccttcagcttggccaccaggtcctcagtggtctccaccttgacgccggccgtgcgctggggcgggtcctccacactgatcacagagagcttggaggtcaggtccacacccaggtccccaggcttgatcacctcgatcttcttcttcttggctttctgcacatgggaagccattgttcacagggctgtggaactcctgccacccttcctgccacctccttcccatg

SEQ ID NO: 378 - DNA, 418 bp, Homo sapiens
tttcagcctttccctacagctctagaatactttaagactgatttggagtattctgttgttcttgtttaatatgaactaacaaatgtattctgaatctttgtttcctcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggtaagaaattcctgtgtaaagtatacaaaagaaaattgctgggttatgtgtatttcaattgacattaaaagatttgtattgcatctgtcactttatagaaagtattaataagcatgctatgcaaagaaaactacatggct

SEQ ID NO: 379 - DNA, 399 bp, Homo sapiens
acacacatttgggcagtttcgcacttaacatttcatgtttttaataaaaggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggtaattcaaacaagagtatgagtgacatgatcattaaaaattcatgaatgggatctgttaattagagaaagtgattgttttaatgttttcaacttggagaaattataaatttagtgtctaagaacagtatattattacttgagggctagtcatatttctttggtgt

SEQ ID NO: 380 - DNA, 391 bp, Homo sapiens
ttttgttaagcatttccctcaaaattgttgaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggtaataatttccatctattcctaaatatttgctttaaacattttaggaatgtgattttgttcttttaaaaaatgatttctgtatctccttccattccttagaaattgtaaatgacttcatccagcttcctttagga

SEQ ID NO: 381 - DNA, 448 bp, Homo sapiens
aggtttctgtggctactctttccttaatttttacttttgaatttaaaaattttttaaagttaggcacttcaatattatttatttttacttttcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatactatatgtaagattgtcccataaagaaattacgggtattgcttttaaataacct

SEQ ID NO: 382 - DNA, 437 bp, Homo sapiens
cccgccttctactgcctttcactgcgcgtgcgtcgtgctgtgggattcgcggacccctctggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggtgagaggaaacgggcggtggggataagtggaggagt

SEQ ID NO: 383 - DNA, 444 bp, Homo sapiens
tccatagttaagcctgacatgagctaaattgaataaatttgcttattagttttaaaatatttaagatttgaaaacattgctttatgagaaaaagctattcaaagtgttcacctaggaaagattatagtatatttcactatactcattgagtatagtcattcacttatattttttcagtctactgaggaaaactaattttaaggaagataataattttcgtaatttttgtgcagcatatcagtgctttcatgccttaaaaattaagaaaaattatctacctctatgtgctacaagatggtcttcaacttctactgtgcctcgaattactacccattatactatttatccccgggataaggacaagagatgggaaggtaagtaataatttgtgtacaattcctgagacttttctggatactttgttttcattttgtggaggagagt

SEQ ID NO: 384 - DNA, 414 bp, Homo sapiens
tgcctaacgatgcatttctcagaaagcatttctgtcattaagtgacttgtgactgtattttacacaagtaaatatttgctaaatgtataataataaatctcaaagccaagaattagtttatggaaactgaaataaagtatgtactggaacagaacctaagaatataatcatactaatacagtaatatgcttaatataattattgtgcaaaacacagggagaatttccataaataatactctaaagcacagtggatattttttaactgtcatgtgatttatcatgtgattattgggttatattaatcccagaatttttatttctcccaggagtgaacatggaaaggtttgcagaagaagcagatgttgtaatagttggtgcaggccctgcagggctctctgcagctgttcgtcta

SEQ ID NO: 385 - DNA, 357 bp, Homo sapiens
tcccagaatttttatttctcccaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggtatgaaaaattgttttttatacaaagtctaatcttttgtaattgtatttcagtaattgttcccaaattactggaatataggaaacccttttcatgtaactct

SEQ ID NO: 386 - DNA, 443 bp, Homo sapiens
actaaaaacatttctttttcttcttttatttctaggctccacttaacactcctgtaacagaagacagatttggaattttaacagagaaatacagaattcctgtgccaattcttccaggtaaggtatagtgaatatgcatagaactatggaattccacagctggaaggaactacatttcatctgacgaaatttcctccttttacagacaagaactgagacccagatatttgaaggacttactcaaagctatacagctagctggtgggaaagcaggactagaactcagttcttttgtcttccagtctagaagaattgagatagccttgtaagccaagcaggaatttctaacttagtgctttaatgttgtttgtaatgtaataaattagaactctagaccaaaattgtagaaaataagttgaaagtgtgaccatcaatgtagcact

SEQ ID NO: 387 - DNA, 414 bp, Homo sapiens
gccaagcaggaatttctaacttagtgctttaatgttgtttgtaatgtaataaattagaactctagaccaaaattgtagaaaataagttgaaagtgtgaccatcaatgtagcacttatgtagaaatacatattgattcgaaattttaaagtatttatgtttttgtaatgtcttatcaataaaaagtcagatttataaattaagcatatatttatagggcttccaatgaataatcatggcaattacattgtacgcttgggacatttagtgagctggatgggcgaacaagcagaagcccttggtgttgaagtataccctggttatgcagctgctgaggtttgtatagttttgttttgttttaatatttataggaactctctttttttaataagtggagaattttataaagttgaaga

SEQ ID NO: 388 - DNA, 350 bp, Homo sapiens
tgttttcatttcccattgtgcgagctctgttctttaatactctggaagggagtaccttaatacatgtctctttattacctgaacattttaaactctgtatttctataatctagagaagatgttcaccttctaagaaacctaaggctgtttactgtttttttcaagattattatgaattctaaggtattaataaatttgttttttatcatttttaggtcctttttcatgatgatggtagtgtaaaaggaattgccactaacgatgtagggatacaaaaggatggtgcaccaaaggtaaacctttttaatagttacgtgcttaataaagcgacaaacaacagaaagaactgt

SEQ ID NO: 389 - DNA, 418 bp, Homo sapiens
tgcactgtctcttctacatctgaatcatagttcaatttaaatctgaccagaatgtgaatgtattttaaattgtcaaatgttgccatttaacatgtttttgcttttcaggcaacatttgagagaggactggaactacatgctaaagtcacaatttttgcagaaggttgccatggacatctagccaagcaactatataagaagtttgatttgagagcaaattgtgaacctcaaacctacgggattggactgaaggaggtatcctggtttgtttctgtaattttaattttgaaagatggaatttaaatttatttgtattatcaggtagtttataatactgatttaattttagttatattttttcattgtcttgaaatgttcattatgactaaaacttatttgcgatatttttcaaggggct

SEQ ID NO: 390 - DNA, 390 bp, Homo sapiens
acctggcaagttttatgcattgtggtgacataaaaacatttttaaaatactgcaggacttttttgtttgctttttttttttttagttatgggttattgatgaaaagaactggaaacctgggagagtagatcacactgttggttggcccttggacagacatacctatggaggatctttcctctatcatttgaatgaaggtgaacccctagtagctcttggtcttgtggtaagttatattcccattagggaaaattctgctgctagagttatattaccatcagtgttataaaataagggttttgaatctgaagactgtaaaatgctttttatttaaagctttctaattttatcaatatgtaaagtgcttatggctgctgtgtcattaagtct

SEQ ID NO: 391 - DNA, 439 bp, Homo sapiens
acatttggattactgcacatagtgctccaaatacttttgagtaaaagaaatttaacctacatgttttctgataaacattgcttacattttagcttgatttaatttgaaataaaaatgtctaattaaatataagtgtaaatttttaaggttggtctagactatcagaatccatacctgagtccatttagagagttccaaaggtggaaacaccatcctagcattcggccaaccttggaaggtggaaaaaggattgcatacggagccagagctctcaatgaaggtggctttcaggtaactcttccaacttttattttccttgtttctgtattataaattcagaattgaacatataatgtaacaaatttagataaagaataaaaacaatattggaataggaaaagtatgtagagtttataaaactgtgtcacacaatacttca

SEQ ID NO: 392 - DNA, 384 bp, Homo sapiens
gacctcccagctctgatgtcctaggagctaattgtttcacagactctaagtgaaatcatgttggacaatgggaagcttcagccacagaacaattctttttttattttcctccctgatgcatggaattaagttttcatcaatattgcttttctttccaacaggagaaggaatgagccaggcggctaccatatgcaagtccaattttaaggtaagctttgacgctgatcagactgctttttagaattgagggaaagagagacttttcttcctggcaggaacaggaggagagcattccttttgggatatgatgatgggtcagcctgtgggcctggagcttccatggcctgtctcttttaggagtggccatggggtcacagagttctc

SEQ ID NO: 393 - DNA, 414 bp, Homo sapiens
taagggactggagagagctggctgggggagctggggaccggggaaaggccagggaaggcggtcgtgagcagggcaggctgtgcccagctgcctccgggatgctaggctaagcctgccgctgctcattccacctcgcgtccattgcctgcagtacatgtactggacgatgctgcagcagctcactcaccactctgtcaacggctgcaacctgcggccgggggacctcctggcttctgggaccatcagcgggccggtgagtatctggctgcactgagggctgcccacgcagagcatccctgctccccacacagccccaagggccctcagctcagcctcgagaagagatttcaggcccgaggtgggtgtatctcacaactctgtcttcctcgtagcctttctctctgggtgcaggag

SEQ ID NO: 394 - DNA, 362 bp, Homo sapiens
caggtcttgctgagcatggtccatgccagagccaaggcataaattcatgttattctttcttccctttcctgtgatgaaggagccagaaaacttcggctccatgttggaactgtcgtggaagggaacgaagcccatagacctggggaatggtcagaccaggaagtttctgctggacggggatgaagtcatcataacaggtgagggctgccaaacccagcagctcgtcttcctccttgcccgccatgcactgttctagctgcggggcgctcctacctggccatgaagccatctgttctcacgcatcctgactctgcctcccagagtctctgcctgcttgttctgtccttccccacagctatggc

SEQ ID NO: 395 - DNA, 411 bp, Homo sapiens
gcctaggtgttggttccggtgagcccagcaactttgtgactgatccttgtcctcctctgttccagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcagctgtgtccacttatgatcgtgatttgatccagtgggtcaaggtgtgtaaagcctccctgccagatattcattaatatgttttctcactcttattagtgaggtcaggggtctttgtggga

SEQ ID NO: 396 - DNA, 444 bp, Homo sapiens
aagtggctaggaccaggctgactgctcttcccccagtccaagggatatttgatttctttcccattcagggaacacagattatttttccttttagttctggaagcagagatggcacaagggagctggggcaggatgctgagaacatggttcttcagtccgctctgcatacagggccacctaaagggggacctgtggactcttcaatagataggctttctgagtaaatgagccaagcccagccaggggctttttctggtgctgacggtgtcgtcttcctcctagccaagaccgaggataggtgtggccattggcgaccagatcctggacctcagcatcatcaagcacctctttactggtcctgtcctctccaaacaccaggatgtcttcaatcaggtaggacattgtgaaacgacttgtccctgacctcagtggcacttactgtgg

SEQ ID NO: 397 - DNA, 447 bp, Homo sapiens
cctgggcttggacaattgtgtgcaggtgcacgagggcctgaggcaacgtcaagagaggatatgcttttctccaggttgatgaataaatgacaaaactaagagcagaggtcctgagagtttgagttagcgggagagaagtggcaagggctggcaggctggctggccttccattggaaggagggatactccctgggttttcctgtacgtgatcttttttctccctgttttggtcttagcctacactcaacagcttcatgggcctgggtcaggctgcctggaaggaggcgagagtgttcttgcagaacttgctgtctgtgagccaagccaggctcagagatgacaccgaacttcggaagtggtgagaagcacgtggtcataggggggatgaggggatgcagcaggggaggtgaaggctgtgtggttatcagtgccattctgagtcacggc

SEQ ID NO: 398 - DNA, 390 bp, Homo sapiens
ggcttcagtgggtggatgtcctctcagctgtgaaaggttcagcatagctctggccccaggccagccagaaggtgcccactggagattgtggataatcttggggatggtctgggctgagcccgtgggtgggaccgcgctttgctgcctacttgactttgaagcccctggttctgtgtttcagtgcattcatctcccaggcttctgccacgatgcaccttccagccaccataggtgagtgcagtctcttcaccaagataagaacggagcagcttcgtgggccaagagggctggccaggtgctttggttctgcatctgtgtggagggtccctgctggtggggggagatggaggaggggctctggggctgttacccgctcctcatcactgacct

SEQ ID NO: 399 - DNA, 450 bp, Homo sapiens
ggcatgtgggttgctgatgggatctgttgggtctttcctctgcaggagactacacagacttctattcctctcggcagcatgctaccaacgtcggaatcatgttcagggacaaggagaatgcgttgatgccaaattggtatgaactgggccaaatgtctgcataagttcaaagtctttcttttcatttccagcagcatatttgtctcaggagctgccaagttcttcttaaagtaaactggggaggaaaagcagttatgatgttgcaacctctggaagcagtggtctcagcttctggtctcctgctcagcttggcttaggacttgctgtgggatcgaagggcaagtcccttaaacttccttggacagcaggggttggaattagattcccttaatccctatgctccttctggagtctttcatttataagctgtgtattattgtactatgggca

SEQ ID NO: 400 - DNA, 350 bp, Homo sapiens
ccatgtgtatgtggcgactctttgtttctagtttttgaagtttttaaagttaattgacaacatataacagctctgatgccctgcattctcttgccttcctttctcaggctgcacttaccagtgggctaccatggccgtgcctcctctgtcgtggtgtctggcaccccaatccgaaggcccatgggacagatgaaacctgatgactgtgagtgaccgcagcgtccaggccttgctggtacccagctctctgttcccacacagagagttctgtggcctcactcacagcaccgttttttttttttttctggtgttattccagctaagcctcccgtatatggtgcctgcaagct

SEQ ID NO: 401 - DNA, 445 bp, Homo sapiens
gccctgcattctcttgccttcctttctcaggctgcacttaccagtgggctaccatggccgtgcctcctctgtcgtggtgtctggcaccccaatccgaaggcccatgggacagatgaaacctgatgactgtgagtgaccgcagcgtccaggccttgctggtacccagctctctgttcccacacagagagttctgtggcctcactcacagcaccgttttttttttttttctggtgttattccagctaagcctcccgtatatggtgcctgcaagctcttggacatggagctggaaatggtaagtgagcttgatgttttattgccatgggatctatagacacccggcaggagagccctttgggatggctccccgcaccatgagccgcccactcccctcctcttcagccacatcggcagccgctctgtgtccccacctggccatcagaag

SEQ ID NO: 402 - DNA, 372 bp, Homo sapiens
aggcgtccatctgacctctgacttagaaacacagtggattcatgccaggcccctgtggcagtcctggtccatggctggagtttggaaatacctgacctttgctctctaggtgacaagtgacctgggcggcagatcagctccagattctaatgaactctcccccatgtaaggctttttttgtaggccctggaaacagattgggagagccgatccccatttccaaggcccatgagcacatttttggaatggtccttatgaacgactggagtggtaattactggagctctgctcctgtagagatgacggggaggaggctggggacttggggcaatttcatagaagctgaagatctggtgcaggtcaaaagtggca

SEQ ID NO: 403 - DNA, 438 bp, Homo sapiens
gcctttgtaagtcctggctgtgcccttcttctgcagcacgagacattcagaagtgggagtatgtccctctcgggccattccttgggaagagttttgggaccactgtctctccgtgggtggtgcccatggatgctctcatgccctttgctgtgcccaacccgaagcaggtaagcacattctctgcaggaagctcccaaacccagccctgctgcctctgaggctgcttgcccactgagtggacatgccaggcatgcagaccatcaggagggaagctctgtgcccacggcatgcccacagcagagtgcctgggagttcctggccacgattacttccaggcagccagggcatcattctcccttgtggtttccctggccctggcacagttcttggagaaaacacagaattttgtaaccttaagaatcttgcaagacccggggg

SEQ ID NO: 404 - DNA, 368 bp, Homo sapiens
ccagtgacctctgtgctgtgctttgccctctcaggaccccaggcccctgccgtatctgtgccatgacgagccctacacatttgacatcaacctctctgttaacctgaaaggtatgttgtagggggactgacatggccaggagctctgaggcaatgtgtgcctgtgtgccttgtcctgaaggctcctgagctttggcaagggtgagggcacgtgctacagccctggagatgtgtgtggctcgtctaaaggaaagaggaggggaggggaggggacaccctggtgctcactgggaacctaactgggcccatagggcattaaccctgtcactgagctctcagtggtagggctgaaaggatggagtccgggac

SEQ ID NO: 405 - DNA, 440 bp, Homo sapiens
gagctgcctattgatgggagggctttgggaggactgggattgccttggcgcctggaatggagctgcccaagctaggccaggccaggcccattggccctctctcttactcaggctgtcctcattagcatcatctgtgacctcatctggtttctagagtaggaaagagtttccacttgtctagtcccatttcctagggtagaatatagaaacggcttcagtgggtggatgtcctctcagctgtgaaaggttcagcatagctctggccccaggccagccagaaggtgcccactggagattgtggataatcttggggatggtctgggctgagcccgtgggtgggaccgcgctttgctgcctacttgactttgaagcccctggttctgtgtttcagtgcattcatctcccaggcttctgccacgatgcaccttccagccaccata

SEQ ID NO: 406 - DNA, 432 bp, Homo sapiens
gggaggagagactggaggacctgaggcccacgggggcggggccaggggcggggcggggctctggaagggcgggcgagactgtggaggacctggagctggcgggggtcagggtaggggggaggggcagggctcggggttcgggggcggggtgttcacggtgagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacgtgagcagtggggctttggcgtccgggc

SEQ ID NO: 407 - DNA, 431 bp, Homo sapiens
aggccacatcatcacgacatggggtgctgtgttcccagggactagccagacacacattccccgcccggtggtggaggtggaacccagggttttgcttctgccatcccctcaagtagccccagccccactgccccgctcaccacggaaggcattatggaagttatcgatgaccacaggcaagtagccagcctccagcagctccagcaccgtgtggctgccaatgtagccagccccacctgttaccagcaccttctctgccatggcacctggcccaggatacagagtctcagaggtggctgaggctgcctgctcagagcttccttcccactggaatcctgccccctaagctcgctttggaaggaggcggcagtgtgccctaggtaccagactggctcagaagtcagccctggggcaagtctgggtaccatcac

SEQ ID NO: 408 - DNA, 443 bp, Homo sapiens
gctcaagccatcctcccatgccagcctcccgagtagctgggaccacaggtatgggctaccatgcccagctaatttttgtatttttctgtagagatggggtttcactgtgttgagcaggctggtcttgaacacctgggctcaagtgatctcctcacctcggccttccaaagtgctggaattacaggcgtgagccaccgtgcccagcctgcacccacctttttgaagagacgctgtagggctccctggtccaaaatgtccatctcctcaaactccacagagcggcctgtcagctcctggacccgccgcaggctctcaggcagggagccccctcctggtagggtacatgtaggccacatcatcacgacatggggtgctgtgttcccagggactagccagacacacattccccgcccggtggtggaggtggaacccagggttttgct

SEQ ID NO: 409 - DNA, 450 bp, Homo sapiens
tcctagtgtctgtgccctgtcccatgcctctcacctccagaagctggatggtcccggtcaggttaactctgtaataatccagaggcttctgcaccgactcgcccacggccttgagccccgcaaagtggatgaccgccataaagctgtactgcaggggtgacatggccagaggttgctctactggttttagtccttggcaatgccctcagcctgcctgcctgcactcacctttttttttttttttgacagtctcgctctgttgtccaggctggagtacagtggtgccatctcagctcaccgcaacctccacctcccaggctcaagccatcctcccatgccagcctcccgagtagctgggaccacaggtatgggctaccatgcccagctaatttttgtatttttctgtagagatggggtttcactgtgttgagcaggctggtcttgaacacc

SEQ ID NO: 410 - DNA, 402 bp, Homo sapiens
ccactgcaactgcctgagccttagcttcctccttagtgggggtgttcggaatcccacccctgggctcagggtgggccctgaggagtccatcgatcagtggagccagggcactgtcaagggggccctcaccttgtctgcctggcacaggtcccggatcatttcctcgatgaagaacttggacttgccgtaagggttggtacaaccacccgtggggtgggcctcatcaaggggcaggtactgggggttcccgtacacagtggctgagctgctgaacaccaggttcttcaccccgtgggccttcatgatctggccgtggagagatggcatcagtgacctctgcctcacacattactcccaccctgttactcctccacaggagaatggggctgaggtgatgagcac

SEQ ID NO: 411 - DNA, 445 bp, Homo sapiens
cttcctggctcccactcctaggtccccctggtcctaggctcacctgtgccatcctctgtgtcatagtcattgccaaagacattcagggcctcccgtcgcccgatcgccacctggaggtggagatcaggtcagttcgtcccagatcccaggcaccagctttaaccccagggccactcctctgtcccttcccttttgccttacctgggagacataaggcatgaggttgttgggtatgccctggggatcctcaccaatgcagccagaggcatgggcacctgtggggttgaaatagcgcagcagcactgcgttccaagtctgtgggatgtgggtcaggtggtgaggccagaggcacaggcagcgtgtcccagctgaacccagagccctcctcatgcctattctgtttttttgagatggagtctcactatggcccaggctggagtgtagt

SEQ ID NO: 412 - DNA, 414 bp, Homo sapiens
agtgccaggtaccctccagagaggtgagtgggaagggccaaagctgctctgttgctgagagctgggtggggtgaggtgggtgaggtgggtggggcgggggggcctaccttcttcccagaggccttctccatagcctggaccatctgcagcactgaatagcctgtgcccgtgcccaggttgtagatctggcccacggagaacagggtttatggagcgggctggactgaccacgcctctgggccgctctgcctggatctggtccctcccctccctcacttctcccttctcttcctacccggcagccacactgttctttcagcttccttaaggctgcaatgtggcccttggccagatccacgacatggatgtaatcccggacacctgcagagaagggagtgtgttggatggggagtc

SEQ ID NO: 413 - DNA, 416 bp, Homo sapiens
agcactcacacatcctgtccagccctaaggctgctgtccaccccagctcctcttgggccaggctggggttggcgtaacaggctgccacatcaccttcccgccgtgccaccaccttgtacgggatctgcaagacaggaggtagttggagcttagctgagccggccctggcccagctgctggccaggtctttaagaagcagaagtgcagagcagcggctggcccgcaggcaccgggtgctaggcaggctgaggagactgggcagtgccaggtaccctccagagaggtgagtgggaagggccaaagctgctctgttgctgagagctgggtggggtgaggtgggtgaggtgggtggggcgggggggcctaccttcttcccagaggccttctccatagcctggaccatctgcagcactgaa

SEQ ID NO: 414 - DNA, 405 bp, Homo sapiens
ggtttgaggtaggggaggccttggcttggccccagcagctccagggccctgagttcctgccagaggctggagagcaggcagctgctgcttttcctggtccttggtaggggagggtcctcaggcttgcgtgccaaagcctgaaggattctgcttctgccagcgccagagatcctcacctgcaacacggcgaggtgtgtgctcagggcccacggtggaatgcagagcctcccccaccccacagcccgccctgggtgggcatgcccagatctgatttagcccctccctggcccctaactgcaggggtcaggccagcactcacacatcctgtccagccctaaggctgctgtccaccccagctcctcttgggccaggctggggttggcgtaacaggctgccacatcacct

SEQ ID NO: 415 - DNA, 440 bp, Homo sapiens
cgctcaggcctggctgattctattccaggggtggatagtgaccatctgtgagaacctgccccagtgtaagaaaacttgtttttatttttaaatactttggaaagctctttcagagcaatataaatgagtgcctgggaggaggaggttttgtgccagagccttgccccctcactcactcttgggggtcctgatgaactcttggaccctgtggaagataagagttagagacctcggcctcctggtcagtggagcccttggcctcatgcctggtgggctaagcgggcccagctggggtttgaggtaggggaggccttggcttggccccagcagctccagggccctgagttcctgccagaggctggagagcaggcagctgctgcttttcctggtccttggtaggggagggtcctcaggcttgcgtgccaaagcctgaaggattc

SEQ ID NO: 416 - DNA, 449 bp, Homo sapiens
gacaggcggcggcgggctaggggctccccgtgcagcccctcaccataggcagcaccaggccctggttgtagtccgtgtgttccccgatgaggttgacgcggcccggcgctgacacggccagctcgggctcggccccgaactcctcccggaaggctcgccgggcctcggccagcagctccgcgacctggggctgtctcaaagcagccatgacgcgcgcctgcagctctgcacagctgctccggcacagccccgtcggcgcgggatgctcgggcggggccccgcgcgggggtgcgcacattcccgccagccccgccccgcgcccggacgccccgcccccagacctcagccggttccgcccccacccgcaactcccgtgggaatccagctgctgggtggtgggtggcaggggctaatggtgccgggtgggatacagcgcccccgatggtgtc

SEQ ID NO: 417 - DNA, 426 bp, Homo sapiens
tcctggctcctccaatcaggtcacgggaaacccagggcaagttcccgaccttctgggggcatcagtttcctcatctgtacaatgggatgctccactctacaagccttccccacagtgtatcagacaaatgaatgggctctgtggctgtgaggtggcactcctagtatcagtgaggacttggctcaggcctgggccccatacctgggtagtactgaatcactcccttgacatagttggcccaccgaggagtcccaggctccagcgagcgctgggctgtgggcagtggaaactgcagccgctggggctcatcggcaccctcagaggtggtgaggagagacaccagcccatccttgcgggggctgcccaccagcaccgtcatgagctccagagcctggcaggagagacaagcagtacgtgaggcttccg

SEQ ID NO: 418 - DNA, 448 bp, Homo sapiens
ccaaggatgctgagctggacaggccaccccccaggggcactgagctgaccaccactgcactgaagccagggaggggggcagctgcaggggaaagaacaggtgatggtaagaggggctgcctgggaggatggcacaggaagggcaggtgtcctggcgggaagggcagcaacggcctagcagctgtttctagggtgtgtgtctcaattgtcagaagccaccaacctgctgggccaagggacccactgccctccattttcccaccctctgaggttgctgggacacttctaattgtcctcctggtttagggctctggagggaaaaaaggctggggttcaaatcctggctcctccaatcaggtcacgggaaacccagggcaagttcccgaccttctgggggcatcagtttcctcatctgtacaatgggatgctccactctacaagccttcccc

SEQ ID NO: 419 - DNA, 419 bp, Homo sapiens
cgagcccaacctgcagtcaatgagcagcgcgtggcctttctgtcccataagtgagatgaactggtccatgatgccacagggcatccctgcgaagctgtgctcggcctgctgacacacctgggcgcgggcagctattgtgcccgagtctgcagtacagggtgaggtggggaggctagggctggtggaagcagcagtggcttcaatgacactccagggagagtccctgccaccccctccataaggcatagtagaagctgggaccacctggagacctcagggaaggagggctgggtcagggctggggcctagctggtacctggacagagctgctggaggaaggtgtacgtggccacttccaaggatgctgagctggacaggccaccccccaggggcactgagctgaccaccactgcactgaa

SEQ ID NO: 420 - DNA, 414 bp, Homo sapiens
gcctccaggatagagcaccctggcagttctcaccctctagctcttccagttgtacctcccggaggctttccttgcccagcgcccgggccacttcttcacattggcgccgccgcacagggtactcgctggaggccagggagtggcggacattagagttggtgatgagcacggccagcttggggtccgagagtggcaccaggctggtctccaaggacctggggtggagttacaatgggggagatgacgaggccaagcgtgtgcttgctgcgccaggcagtgggcacactcccacccaggagctgctgagtgcagggcgggaggggacgaggggagcgagcccaacctgcagtcaatgagcagcgcgtggcctttctgtcccataagtgagatgaactggtccatgatgccacaggg

SEQ ID NO: 421 - DNA, 445 bp, Homo sapiens
ggatattgaaggggtgggcctgggccggcctgtgcccggcaggagcggggcgcccagagggcctcacctgagtgagcggtggctctccaccatgaggcggccaaaggctctgtagtcgccacgtctcagggcggccgctgcctgggccgtgcgccgaatctcccccaccacgtgccgggcccgccggaagccctctttgctcaccaggtccctggcagctggggaggaaagaggagtcagcagccgccttctcactgcctggggccccgacgcctgtgaggaccagcaggcggtgatggcagtggccctggctggacggtgaagggtggaaggccgcgggggcagggcagcctggctctctcagacgtgggtctgaagagcccctttatcacagtgcctcctcccccgactgtaaaatgggacaccttggtccttcagggagcag

SEQ ID NO: 422 - DNA, 390 bp, Homo sapiens
gccgtagtgctcctgtaagaggcgggctgggggtgagtggcagggccccgggaagctgccgctcctgcccgcccaggccctggtgcccgcccacctggatgtgccgcatggcgtggggagcagcggaggcctccagcagtgtcaccgtgcagccaccgaagccaccgcccgtcatgcggctgccataaaccccaggcacagcaagcgcagcctccaccagctggtccagctctgggcagctcacctcatagtcgtctctgcagagaggatattgaaggggtgggcctgggccggcctgtgcccggcaggagcggggcgcccagagggcctcacctgagtgagcggtggctctccaccatgaggcggccaaaggctctgtagtcgccacgt

SEQ ID NO: 423 - DNA, 446 bp, Homo sapiens
cctagggtaggggagcggttctgacatcccccattctctgacacccaagcatacacccacctctagaggaggcaggtaccacattggaggcacaagtttattgagcacccggatatggaagatggcaccgggcacagagccgtgggactggcctgcaggccccgcaccctcaccgtgtgctgtcctgggggtgcctcacaagcacagcaccttggctccatcggctgcttgagagaggtagaaggtggcagtcccgccgtagtgctcctgtaagaggcgggctgggggtgagtggcagggccccgggaagctgccgctcctgcccgcccaggccctggtgcccgcccacctggatgtgccgcatggcgtggggagcagcggaggcctccagcagtgtcaccgtgcagccaccgaagccaccgcccgtcatgcggctgccataaacc

SEQ ID NO: 424 - DNA, 449 bp, Homo sapiens
ggctggccaatcatcgggggcggcgcggggaggggtggtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacggtaactgcaccgcggcagggactcgctggggcgcggagccgagccctccccttccttaggaagctttcgtcccctccgaaggttggaacgctcatcccgagccagaccgacaaggcgtacagtctgcaggcctgtacgagcagcaggccaattggcgctgggaaagtccaatcctgggcctctagctcctgagcgggacagggccgagagggcgctcccgagcttgggcctgctggtgggtgagacccaggagagagggag

SEQ ID NO: 425 - DNA, 449 bp, Homo sapiens
gagcgggacagggccgagagggcgctcccgagcttgggcctgctggtgggtgagacccaggagagagggagctagagagctctgaggactgatcttgactgtctgcccccagaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtc

SEQ ID NO: 426 - DNA, 450 bp, Homo sapiens
tcccctagggtgggccttccctactcccttgtagcctgtccagtctttgaagcccaccaggtaactggtggtatggggcagtgagtgcttctagcctatccttgtcggtaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccaccca

SEQ ID NO: 427 - DNA, 450 bp, Homo sapiens
ctcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcaggtttgtgaggtcgccccttcccctggatgggcagggagggggtgatgaagctttggttctggggagtaacatttctgtttccacagggtgtggtcaggagggagttgacttggtgtcttttggctaacagagctccgtatccctatctgatagatctttgaaaacaaaggtgccatgatgggctgttctaacccccacccccactgccaggtaagggtgtcaggggctccagtgggtttct

SEQ ID NO: 428 - DNA, 447 bp, Homo sapiens
ggacctgcctgttcttctctgcttttgccccttgacaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcct

SEQ ID NO: 429 - DNA, 444 bp, Homo sapiens
gcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatggtcagtctcccaagtaggatcctggggctaggcactggatggaggttgctcccagtagggtcagcatctggaccccaggctgagagtcaggctctgattccagatctagcctccatcatgaagaagctcttgaccaagtatgacaacctctttgagacgtcctttccctactccatgggctggcatggtgaggcttttcaagtacctatatttagccccaacaccatttctgggctcctggg

SEQ ID NO: 430 - DNA, 450 bp, Homo sapiens
tggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgc

SEQ ID NO: 431 - DNA, 450 bp, Homo sapiens
cgctctgccactgtccggaaattcatggttggctacgaaatgcttgctcaggctcagagggacctcacccctgagcaggtcaggactcagaacagtctggcgtctccagactctcacatgcagtatgtgcaggcacctgatacttctgttgcccttgtgctccagtcattgcacaaggcagaaaacagctctggcaggaagggactgccaaagttaggagccctagggcctggaaggagagtatggtcctcagatcccccttctctcctgcttcctccagggaacccaacagtcatgaccctgatagtttcccataacaacctgggcattccttgggactcaggagctgctaaactctttcatcccctggtggcttcagcagtccttatcaccagcctcacaatcccacaggcccacccccagtgggcctgtggcattcatatttcatat

SEQ ID NO: 432 - DNA, 403 bp, Homo sapiens
cagcccagcccttatcctccttaattgctccctgtcccttttccaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaa

SEQ ID NO: 433 - DNA, 449 bp, Homo sapiens
tggggactgtggaagtgaagtgcttcatgcagcacacagaggccccatcaggccttgcgaggggctcccagctctttctcccacatgctcgggaggagggatgttcctgagacaggtaagctccgaaggcagcccaggggtgaggcccgactcctagcaggctggtggacgcaagggagtgagcgaagctacacgcaggaatcaacgctccattttgttaagagacaaaagtcatcttcagatgacggtgtttgcaccctgtaactgatggtgatttacatgggggtccagaaccccttgcttggtgggaagacagatgtggaaaaagatacttaaaaaaaaaaaaaaagtgcaaacccagcatgcgctatgtagaaatagagggaggtatgaggaccccccgggcagagatgcttccagacagagagaacagcaaatgcaggaggggt

SEQ ID NO: 434 - DNA, 427 bp, Homo sapiens
tgaaaactccaaaccgactctgtattaatcttgtccaggtacacatgacattcacgccctgatccttgggagagctatcacgggaatccaggcgttcacggccagcaagtgagccgctccatcaggggcccgaaactctcaagcccctttctggagagatgcctggctggaccgtaggagcgctgtgctctgagcttagaaagggaggtggcggatggagtgggaagtgagagacactgatttttaaatatcaaaatttcccttctgaagtcgttcagatgtgttccttaaaaagaagatggaattctctgtagagcgtctcaatccacttttaaccatggatgagagcagactccatttaccctgaaatagcagcttctcttgagaggagagtgacatggaagcaactccgtctgctgcagctgac

SEQ ID NO: 435 - DNA, 432 bp, Homo sapiens
gcagaggaatgtgcgaggagagggaagctggcttgctttctgcctagagtcctcagggccctgtcctgaccctcctctcactccttctccaggtgagctcattcattccacagctgctgctgaaacaatgactcccacagaaccatctccagaccctcaccccaccccgagttccgggtcagaaagttgaactgtatcctggacatgtggatgtccctggccaccgaaagtggctcagataaacaaggacaacacagaactcatgttcttgtctctgccagagaagccaccacctaccggaaaccaccacaagctggaaagcagacagcagtgatgtgcttgtaagcatttagcaactggctgtgtgatgggggggaagccctgattcgtagtgtttgccaatttccgtggtgcagagcctcccaccattag

SEQ ID NO: 436 - DNA, 447 bp, Homo sapiens
aggggctagcctatctctgtctgggccccccgatttccacaggcaaggctaccttagcccttttaaaaggcagagctgcggagggggccggattctaggaggaaccaatgaaaagcctcactcggcctccgctcctcccacttcttgctgaggtcaaaggcctgcgtcagttgcactgtagcctcggcagtgaaccgggaggtactaccaggtaaggaaggtgcggtagccccagccgtgggtgagaggagctccgctctgacacccccgctcctgtaggtcgccgtcgttgctccgctcgctctgagagagcatggccctgagaggcgtctccgtgcggctgctgagccgcggacccggcctgcacgtccttcgcacgtgggtctcgtcggcggcgcagaccggtcagtgtggggtcgggagtgtggagggaaggagggaggaact

SEQ ID NO: 437 - DNA, 446 bp, Homo sapiens
gggactttccggggtgactttcccgttctgtgcttgcagagaaaggcgggagaacacagagccaactggctaagtgtaaggacctctggtcgcaccgtgtgtctgctgcccctgttcagctgtctgtctgccgcaggtggactctgtcccagaatccgagagctgcccgagcggggtggcagggtcgtggccagggtcagaggcactaaggcagtgagtgcgctgtgcctgcggggccggagaaaagtcacctgatcagtctcgcttgcagctcgcactagccggggggcgacatgggtgttggggggtagggctgatgagggtccgagaagggagggcacagtgatcttgcggactggaccgaggcgaattccccttcccagcctcgcgtcccgagtttgactggcaggacccgctggtgctggaggagcagctgaccacagatg

SEQ ID NO: 438 - DNA, 421 bp, Homo sapiens
tgatgagggtccgagaagggagggcacagtgatcttgcggactggaccgaggcgaattccccttcccagcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggtgggcgggctggtgggtgccctgagactgctcctccgcctggagccatagccaccccacctcaaggcccctctgtccttggggctggggcttcctgtggcctaggcctgggcctgaatttgggcactggtccctttgcagtttttcatcgggagatcatttcggagatgggggagttgggtgtgctgggccccaccatcaaaggtag

SEQ ID NO: 439 - DNA, 409 bp, Homo sapiens
ctcttgggtcttagctgggcagggccctgttctctattgtcctgctttcccctcctactaccaccaggatatggctgtgctggggtttcgtctgtggcctatgggctcctggcccgagagctggagcgggtggacagtggctacaggtcggcgatgagtgtccagtcctccctcgtcatgcaccctatctatgcctatggcagcgaggaacagcggcagaagtacctgccccagctgggtgagtggctgcccatggggcctggtggaaggaagacagtctctgaggtctggaactcaagggtggggctgtcccctgagcctattctgtccctatctcaaagatagcataagtggccacctggacccccgccagaccctgggcttcacctggagatctgatccctggcca

SEQ ID NO: 440 - DNA, 350 bp, Homo sapiens
gtatcagggaccaggcagccttgtgactttgtcttgtgcctgcagccaagggggagctcctgggctgcttcgggctcacagagcccaacagcggaagtgaccccagcagcatggagaccagagcccactacaactcatccaacaagagctacaccctcaatgggaccaagacctggtaagggttctgggtggtgggcaggtggtgaacaggggcaaaggggcactggtcagacccctcaccgactgttccatccccaggatcacgaactcgcctatggccgatctgtttgtagtgtgggctcggtgtgaagatggctgcattcggggcttcctgctggagaaggggatgc

SEQ ID NO: 441 - DNA, 401 bp, Homo sapiens
agcatggagaccagagcccactacaactcatccaacaagagctacaccctcaatgggaccaagacctggtaagggttctgggtggtgggcaggtggtgaacaggggcaaaggggcactggtcagacccctcaccgactgttccatccccaggatcacgaactcgcctatggccgatctgtttgtagtgtgggctcggtgtgaagatggctgcattcggggcttcctgctggagaaggggatgcggggtctctcggcccccaggatccagggcaagttctcgctgcgggcctcagccacaggcatgatcatcatggacggtgtggaggtgccagaggagaatgtgctccctggtgcatccagcctgggggtaagtggcagccactttgggaatgggtgttgg

SEQ ID NO: 442 - DNA, 357 bp, Homo sapiens
ctgagcatcgaacccagatgccaggctgggtgggactgtgtgcaaaccgagtgagcaggcaccgagcttcagtgccagggccatctgtgatgtgaaccacaacctgagtccccctgcgtggggtggctggggaggaggctttccctgcttcagagttggttctgcataggccctcttggtgtctcttgggtgggcctgaggcgccatctcaaccctacagggtcccttcggctgcctgaacaacgcccggtacggcatcgcgtggggcgtgcttggagcttcggagttctgcttgcacacagcccggcagtacgccctcgacaggtgtgtgagggctgcagtgagattctctggggg

SEQ ID NO: 443 - DNA, 410 bp, Homo sapiens
cccctcgctcttaccctgccattgcccatgtaggatgcagtttggtgtcccactggccaggaaccagctgattcagaagaagctggcagacatgctcactgagattaccctgggccttcacgcctgcctgcagctcggccgcttgaaggaccaggacaagtaggggctgtgtggtgggggcggggggatggcagcggtggctggaggaccttgtgtccttcctggagagaaaggtccttcctgcctggtggccctggggacctgaaccttctgctgtccctcttgtccttgatgggctgggctgaggacagccccactggtccctcattgggagcttggctgcatcagggaatccccaccccgggctaggtttgcttggagcatcgggatgccaggatccccagtccttg

SEQ ID NO: 444 - DNA, 353 bp, Homo sapiens
ccctcttgtccttgatgggctgggctgaggacagccccactggtccctcattgggagcttggctgcatcagggaatccccaccccgggctaggtttgcttggagcatcgggatgccaggatccccagtccttgttaccctcatgtgccactcccagggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtaggagctggacctcagagggctcactgaggcctc

SEQ ID NO: 445 - DNA, 434 bp, Homo sapiens
cagctcgttatcctcctcgctgcggggccgctcgcccttccagccgtccgcgggctgcgcgctcttggcctcgggccgcgggggcttctccgccggcctgctgggcccgggccgcggcggatcccgctcggggaacccattgctgcacctggcgccccgcggcttctccgccggtgcccgcacagggcccttctccatggacccgccgcagccgctgccgttcgggaaggaccccggggcgcttcgaggtctgcggctaaactccgccggtggccgcggacaatgggctgtggccggagtcacctgaggaaggtacgcaacctgcttagatcacactccgagccgggagcggccacaggctggaaagcccggccgcgcctcctttttatggcccggcggctcagcctgcgccgcggagcgctcccattggccgg

SEQ ID NO: 446 - DNA, 440 bp, Homo sapiens
ggcaactccggaaacttcctggagccggcgcgcgtttcctgcaagcaccgcccccgccgcccgcacgctctagcagcccgcgggcgcactgacctgagatggtctcctggtagcccttggtgaagaactgcatggccgaggccgccctccagggcgtcttgagcagcccttgccgctgggggttctcgcccagcgagctcaggatggacgagtaggcggctgccaggttagggaggttcagctcgttatcctcctcgctgcggggccgctcgcccttccagccgtccgcgggctgcgcgctcttggcctcgggccgcgggggcttctccgccggcctgctgggcccgggccgcggcggatcccgctcggggaacccattgctgcacctggcgccccgcggcttctccgccggtgcccgcacagggcccttctccatggac

SEQ ID NO: 447 - DNA, 352 bp, Homo sapiens
aggcttatcctgagagccttctgctactttggttttgttttttaagtttcaagttattagtcaggttaataaagaataaccatatatgtataattgtaaatacctgagatatcagcaattggcagctaaaaattttaaatataattattctaattgaaaaactttcactatgttttaaattgctgggaaacaacaaagagaaccttacctttccaacaaatggaaccaagtgatgctcacacatggaaaacatgtctatgtccttcacaatcaccatctcatcatgatcttcatcaaatatagcatcgtttaggacatctgaaatcagaggcttgctttagtaacatgtcca

SEQ ID NO: 448 - DNA, 354 bp, Homo sapiens
aggtgggctgagacttccaggatgtatgtatctatggaagaaagggtgggaagtggaagaggaagcaggcagtaggggacgagaaggaaggggcatctgtgtttcagaccctccaagtctttaagttgcaatatgacttccaagttagatccatacaggtaaagagagaaagcctgatgagatagattctcagcagatgagggcaggtcctataaacctgtattcttgttcactgcacagtcacacttacctcgcaagtttgctgaggccaaggacttgcttgttaggaagataaccaatatggaccttcagagaagagacggaaatcattagctgagtgaaaatacagtgcct

SEQ ID NO: 449 - DNA, 448 bp, Homo sapiens
actttttgtgtaggaaaaatgttttctgtagccaggcacagtggctcatgcctgtaatcccagcactttgggaggccaaggtgggcagatcacctgaggtcggaagttcgagaccagcctgatcaatatggtgaaaccccgtctctactagaaatacaaaaattagccaaggcatggtgatgcactcttataatctcagctacttggaaggctgaggctgcagtgagccgagattgcaccactgcactccagcctgggtgacagagcaagactctgtctcaaaaataaaaatttaaaaaaagaaaaaaaagaaaaatgttttctgttaatacagatttttaaagcttaccttgtagtcttctactatagatttctacaatcctagaaaagaaagaattgttttagttaatcacaaatcatttgaagtaaaattgataagccttcctca

SEQ ID NO: 450 - DNA, 424 bp, Homo sapiens
tgtgtggcatcacctggtgctacaaaatatgagaagcactaaatagcaagatcacttctagtgcaccattatgacgttactaaaggcagatgcagacttacgttgcttcaaccactaccccgactccagcaggccgcaaggcttccgtgattgctacagcaatttgttttgtaaggcgctcctgaactgtggatgtgataaggagctcagtttgagagtctgacacaaacagctggaagctttttctgtctctagaacatttgaaatcttaaaaatcagacttctgtgagatttaagagccaagacacaccagcttttaccagactgctttgtctgctgactgggccacagagaggcccggattcaactccctcacctgaagtacagggctaaagagatctcagaacaccctgaagccctccag

SEQ ID NO: 451 - DNA, 447 bp, Homo sapiens
atctggcagtggttttgtgcacgtacttacactattagcagttcactttaatattgccacaaaaaggtggcaagaagaaagtagagggctcaaccctttattatatttatttgacttcctagaaataattttaaatataattagtgacaaggaataaagttcacatctgtaacaattgaaaatggaatgtacaaacaagaccggacagacagacaatgctactggcagtacgatcggcaaccaacgcacacacactgaatgaagctcagctcctaatgagagtcaggaactcttcccgagtctttggatcctcccggaacacacccaacattgtgctggtcacagttttgctgttcattttctgtacacctcgcattaccatacacatgtgtctacaaaataaggcaacacaggttgtttaaaggagtagacagctgctggtttggt

SEQ ID NO: 452 - DNA, 430 bp, Homo sapiens
aatgtgcctttttaactcacagtaaaatcaaaaacatagacattccaccaccttcccttggtgactaacattacgactgctaaaaatatatttttaaatgtcactggtggtttaataaacatgaccaaagtgaagtctgttgaacttgaattcacagagcaataccgcactaaatattttagcactttcggcactacaccacttttattggaggaagaaaaaaaacagtatactgggcacagttccctctcattcccaatgctcctatgcttatgaggcaaattactgtactatttgaaaaaaatacactaattcttctcccttcccaggcccctctggttatctggcagtggttttgtgcacgtacttacactattagcagttcactttaatattgccacaaaaaggtggcaagaagaaagtagagggc

SEQ ID NO: 453 - DNA, 444 bp, Homo sapiens
tgcgtggaagctatggttctgcagacctgaaaatgatgggcactctcaaatgtttctggaaatacttagaaaaatatcttataagattaaaaaaaagaagaagaagaaacattttgaggcatctacatggatcacacaaaggaaactcaataaacctataaagttaaaactgagctgactagttatttgcagtgtgagtactaagtctcataaaataatggcttttttaaaaaggcaaaagtatctacactctaaatgatattcttatcaaggcacagagagttaaatgtctaaatccctgtatgttgacacgagaatacactcgtaaacaacaccaggaactaattccctattcttgaatttaaaaacaatagaaggtagaaatgtgcctttttaactcacagtaaaatcaaaaacatagacattccaccaccttcccttggt

SEQ ID NO: 454 - DNA, 432 bp, Homo sapiens
agggtaatgggatgaatttgaagagcactatgtcaaccaaatactaaacttcatggaataactgtgtttgtgtttctgtggaggagttgcggttttgtttgttttaatttggcccacgctgccccaatggaggaaattttaagataatcattaataaggcaacagcttccaggattaaaatacctataccatctatacggagttacaatgaggacaagacccacatagaccacaaaggaaaccgggaccagaagcttccagtgcattttcacagatcgttggtacgatacgctttggttaaaacgttggacacagctcataatgtcttccaccgtcagttcattctgtgctcgttcaggtgcgtggaagctatggttctgcagacctgaaaatgatgggcactctcaaatgtttctggaaatacttagaaaa

SEQ ID NO: 455 - DNA, 431 bp, Homo sapiens
actgaaaagaccacagtgttgcataatgtaaataacacttgtttatgaaaaaataggactgtgcctaaagttttcctttttattttttaaaaacaaagagaaaaccttttaatgagaaacaatgtgaaaatttgaaaaactggtaaaaatactgaaaatttgacttactgtgccatcctcaaaaagccgaaaattgatctgccgctgagcggccctgcccaagacctccttcactgagcagccacactgaatcttcaaggtatcaaagaacaggtcatgctggagttgatgccctgctcgcttgagacctacacaagataggagatcccccaaactctcatatagaaacctgctcctcagccattgacatgtcacagaataataaagagataaattctactagactcttgttggtcctggggagtgctttg

SEQ ID NO: 456 - DNA, 432 bp, Homo sapiens
ctaccagtgtcacacttgggccccttctccctcacactcaggggataagctacttttgctaccacctccaatagttatgatgaggaacgcatgtttttattttacttactgcagatgactcacaaccaaagatccacaacaaatcgtccagatctttttcattgactgtttcatcaagagaaataccaagctacagaaacacaaacaaaatggaaaacatcaactctaaactccacatcactggaggaatcccaagagaggtcaaaggggagacagtgctaaacaaaatcccatcattccaaaatatcagggtacaattatctccacgctaaggcttagaggaaggtggctagaccagtcccaggtttcacaaggcttcgagttttgccagccacctctgaactctaacattccatggctgcaggacactcc

SEQ ID NO: 457 - DNA, 392 bp, Homo sapiens
ttgggagtgaacttcagcctggcaattattcatccctgcttcctgactgccaagggagcagagccaccaggaaacaaagtgtgcttttcccaagtcaggaacgggatcgttatgaggatgaaatacttgggagccacggctgagccagaataaccaggccacagcaggcgaaatcagcagcagcactctgcctaactccctagctgattaccaaagcacaaaacgcagaagtcacacaagacacacaaacctgttgaacacttgatgggtgaggaacgggctggtcctcttgaacacagaccctggaatacctctgcactcctctcccatgctttcagcaaccagttcctgaaggagaaacacagagatgatagggccagaactgtgcctgg

SEQ ID NO: 458 - DNA, 435 bp, Homo sapiens
agagacgtgggattggggtagcttggaaatgagaaaaaaggccacaaataactaccagtggaatcatgctgtgaacaagggaaatgtctttattttccagtttcttcatgtaccggacaatgtttgtttcagagtggtagctgtgaacacaaaacacagaattaggggccccaaaagtagatatgagtccatgcacatcctcctgacatataagacacaccgaaatctactttcaaaatgcagatcaattttggccacggacaatatgtcaactacactcagagagaagggcacagacccccacaaacctcagaggatgtcttggacaagaagctgactgtgggtatgagttgaaggttgggaagaagaggatatagggctcttgggagtgaacttcagcctggcaattattcatccctgcttcctgactgccaa

SEQ ID NO: 459 - DNA, 416 bp, Homo sapiens
ggggtgggggagggataggatagaaaggcataaataccatatacatttaattaattttattaaaaaataataagtttacccatacatttaaatgatgaagtcgtgagaaatacagggttactcccaagattggtgaatagcaaggtaaagaattattaaaatagttcttcaatcacagaatcacagtcccagtagatttcactagttctgggcttaggtggaagctagaacactgccccttgctgagtatccacttacagaagtgagctacttactgcgagttcagacgaactgttcagtttcatggtgcaggatccctttaagaagaacatccaaaatgtatcacattagtgattttctatagtccatcaatcaaccctccattctcccagcatggccacccctttgttgctctt

SEQ ID NO: 460 - DNA, 397 bp, Homo sapiens
accttctagccatgctctccccagtggagtggaactgtctagcaagtcacagaataacacaaaaaagttgttgttctaagcctttaagttttgtggtgtatgctatacaagaatagattgctgaaacaataagaaaagaaatgcccttacctgtttggctggaaacagacctggtcataacctgtgagttcacacaaatccttctcaagctctcggaaaagctgctgatatccttgagcttgatccagaggcacaaaggggtggatgtttgcaaattctttccatgtgataggctgaaaagaaagaaaacaaaaatgcatatatacatattataatagcaatagcaataataactttaataataatgacgatgatgagaaaagctatgtgccaggca

SEQ ID NO: 461 - DNA, 445 bp, Homo sapiens
tggctgacgtttgcattctgggtttgagcaagtcttttatctctgaatgtttttcctcaaaatggtcaagtgggatgtcttggaagcaaggatcataatggctagttcacagaaatttgtttcttgactatatgttccctcatctgcttccaagaaggcttggagggagtgtcccacagaagggaccctgagagccaggacctctgtgccccatggtgagcaagcgccacctcctgccatactcaccgttctgtgcccctctcctttctggtttaagtaggctcggatagtggccagtccagcatattctccctgggctccgcttgcaaagacaagaagaaagggatcacggttaggtcttctggctttcatttactcattcaatatttattgggccctggccaggggttcaccagcacgtgacacatggtcactgtccagacgc

SEQ ID NO: 462 - DNA, 425 bp, Homo sapiens
gcagaaagaggcaggcaggttctgcaaggagtactcttactaccaccatgaataattcattcagttttttacacaagctggaattagaaaacggggatttctccctgttggtgatgggaggggtagagtagactctggtcaaaggaagaactgcagacttttcattagaatgcaagagaagacatttacataatccatcaagtccctgatccccaccagcactccccatcccggcctctcccatctgctaaggagaagacaagtaccatggccttgaggtgaactgcatcgatattcccatatttatccacctccacaggctgaatcttcatgcctgccatgtgggcacttgctgggttggtcccatgtgctgatttcggaatgaggcaaacctacagaatagaaaggaagcaaagaaagagcaa

SEQ ID NO: 463 - DNA, 350 bp, Homo sapiens
agtggtcaggtcgtgggtctgagttccctcaggcaggaagcctctcaagaagtcagaatttttttttttttccacatatccattttctcagtgggaactaagggcgggcctcttcagttcccacctgagcattcatatttgccccgtctaggtagacctgtcctccatgttgatggatgaggtcacacacgtcactgatgttctcttcaaacaccccattggtggatgggtatgtaatcatgatagctgctaggttctccttgtgcttatccacctgtgaaagaaaaggggtagagaaggacatggagggaggatatgtttctttcttggccaaatcctcgcctttcatt

SEQ ID NO: 464 - DNA, 448 bp, Homo sapiens
cccagcccctacaagtgcactacaccgatgagggtatcctcaacacatgaagactttgatgggatgagtagtctatttagggccactccttcattctgtctccaaagccatcctgaaaccagcagcccagaacttacactccgatgggccccatgccaggaccacctcctccgtggggaatgcagaaggtcttgtgaagatttaggtgcgagacatcagacccgaagtctccagggcgacagattcccacctaccacaaaggcaagggccaaaagcaaaagtcaagagcttggaagcaccctccagtgtgaaggccatggctggccggtgctgccttctcccctcagaggaaaagcaggcagagccacatccatggtgttcacagaaatgtcctctatactggcccagttccgtagtcacaaactggcatccgataggcagagtgctt

SEQ ID NO: 465 - DNA, 443 bp, Homo sapiens
ccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagt

SEQ ID NO: 466 - DNA, 414 bp, Homo sapiens
aaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggcc

SEQ ID NO: 467 - DNA, 444 bp, Homo sapiens
accaaatatcccaccttcccgcggctccggaggtacccgccactgttttattttaatccacacattcccagtcctgagcaatccttaccccagagctcgattttcagggaaccacaaaagacaaataggccagaataatctaagtccaagggagccctcccggccacttacaaacagggtcttccattttcaagggtcttttcaaacggatgttggcagggaccgtcttctcgatcaattcatcaatgctctaaaattaaaacgcaaggcagaggaaagtgcctctgagttaaaagagtcacctctgtgttttgcgactacaaagccttgtgggaacctcattgaaatcgcctaattagggttctttttaaaagaaaaggaaaactctgagcaagccagaatgatttggaggaaagaaaatcgtgaagtggggtggagattccg

SEQ ID NO: 468 - DNA, 425 bp, Homo sapiens
agtctgcagtatccggtccccatgcatgcctgacgcccccacccacctgcacacctgcacatactcccaggcctcaccttgatataagcccaggaaatgggcaagatggaactggagccccatggggccgcactgacggttcccacaggacaggcatcctcattccgctttagtgaaatgacgggatgattgggcaaaaacggggcgagatgtttcttcctgtattttttttaagtgcaaattcagaaaatgtaaacgattcagtttaatctaatgggaaggttctgggccctcccagaaagccttgttcttagcagaggagctctgacagtggaagggactctccacctgctgggaggcagatgttcaggaagcgatccttccttccttcctcctctggtggaggtccaccagccatcagtgtc

SEQ ID NO: 469 - DNA, 382 bp, Homo sapiens
cttgcccatgtcagaaaagcgcatctaggtcaaacttagtttggccaagaaaaaaaccaaagtaatgatagattaaagttgatacttgcctcttgcacccctgaaaagaattctgtagtgtgtttctaatcgcttggccatgtagttggcatttaatatcgcagtttccgtggcttgtttaagacccttgcctcccatcatctgcaacaaagggaaaaagagccattagccattgaacaggcaaacacgaatgtgaagaaaccaaccaaaagacacccccagataaactccacccacaaaggaaggcagcccaccatgactctggagtaaagatgagtggaaaattccaacaaggatatctgtcagatccctgtaagcctgt

SEQ ID NO: 470 - DNA, 360 bp, Homo sapiens
gaggttgccaagaaccctgagctccccatttatcccccagatcagtttactgtggtgcctgcattttccatttgtgctttaggaagtggtccacagccagcatgggcggcggcatgaatgtcaaaagccacttaccataatcctggagtctcttggccacatccacagcctcaatatttgcagactttttgaagggtctcgtgtccaaaataaattcatgacccacataacctgttcaggaaagttgtttcagcccaagattagcatcagcttattgttttacccaaacaaatgaataagtaatttaataaataagtgcatcagctttttatgtgtatcagcgaggaccaagaagccatg

SEQ ID NO: 471 - DNA, 442 bp, Homo sapiens
ggacagcttccacaaccacatcatccttgagtaactgctatgctgttcaagacgatggaaacttcaaagtaacaactgcatcttctcagaagaattaccttattctagggaagagtatcatcctcagttgagagttcgggagttgctggtacactgtccagacatcattttctagtttaaggaacatttcaagcaatgttccagggcctacgcaccttcagcggattgaccctggggtcgatgcggccctcctcaatgtcagcaatttcctgccgaatgctgatcatggcatcacagaatctgtccagctctgccttgtcctccgactcagtgggctccaccatgagggtccctgccacaggccaggacatggtaggggcgtgaaatcctgcaaagggagacaggagaacttgcctcactgaaggtcagtggcctacccagt

SEQ ID NO: 472 - DNA, 410 bp, Homo sapiens
tcccccactctgttccctatgggttcccagatctgtggttgatactgtgtgacctcgcctctgaaagccaatttctttgctcctcattcctcttcaagacccttatttcacaaggtgccccacatatggtttctgtaatcatgaggctaagagcgtacacccgtcaggataggagctggcccatgccttcccagctggcacattcagattcagagaacttacgagtgggaatgctgccacctctctggaataaggccggtcccagtgggaagatgtaacgcaggtcagggagtgtggagacatctgagacagagacacggacagaggaggggtcagagcaatacactctcttctcctcctaccctgcacctcaaccgtcaatcttctgacaggagcccaggcagagaaag

SEQ ID NO: 473 - DNA, 447 bp, Homo sapiens
gcaactggcacatgtggaagcagaataccaaagcaaatccgtcttccaaccatcagcttcgactccctccagctactgtatttacatttaccttgacagagattacagagatatacacagtatataaaactcctacttgaggctggggtgggagatgaaatctttcttgcttatcaaatgctctggggagaggcatcaaatcagtcctttaaacttagggacagaggactaagaagacgccctcttttgttcagaaaatggagactcataaacttccatgggtgggcaggtacaaaccaggtgctgatctccatatatgtcatcaatccgggcaatcgttggccagaatttgttctctggtttcacgaagggctgcaaaggacaaaagatggaaatgctgtgagatgttctgggaggtttctcttagggcaaaggaggtggcaatgc

SEQ ID NO: 474 - DNA, 441 bp, Homo sapiens
gctctgagactgcaaggggacagatggaggatggagagaattatgcaaatcacagtcatcctgttcctgaactgagaaatacattaccatcctgagttctccagtaagttccgcaaaatcgtctgtggcactgagcagttataatagcccatgccaatatacgatctccagatctggtttttgcttgaaatggcatgcagagttgcaaggatttcattttcacctaattgtgggaaaaagagaaatgttacagacagatgtctcagaaaagagctctaattacagtttaaatccctcattttgtttgagtatttatgacagaataactatatggaaaatgtaagagtcatccatccaaccaacactaagtactgtatgcgacatctcaaaaaaaaaaaaagtccccaaacaacactcaatttctcctcaaggttggccccc

SEQ ID NO: 475 - DNA, 427 bp, Homo sapiens
tccccaaccccaaccaaaatccgggtggagacaccaagaaggaccctgagaggaaatatccaacctctaggtttttgaacctgttgagtttttcagtttctctgaaaagtcatactctagaaagctgactaaagtaatattcacaatatactatagaaagaaaacaaggccaggcgaggtggcccacaactggaattccagcactttgagaggcctctcacctgtagcacagctgcagtgcctctgcggctgcagtcccctcatccagcagggatgcattggccatgtccaggcctgtgatgtcacacaccatggtctggtagttgagtaaactctccagcctcccctgagacacctcaggctggtatggagtatactgggtgatcctgcaagggaaacaaaaggtcttgtccaaactgactgctgt

SEQ ID NO: 476 - DNA, 350 bp, Homo sapiens
gcccagaagaaagtgagaggtaaggcaaaactcagcaaccccaatttaaacagcaaaaaaccctgtttcagattcacctccaatcagtttggaagtgagaaagagaaagaaacagcagagatgaacatgacattatactgagtttaaaacacgaatcaaattaattacttggctcgagtctggacaacagctattgtctgtgggtggcaacggggatcaacgagaaatttcctcctcttgttgtgtctgttgaaaagaaaaagcacattccaacgtgaacattaaataaataggactatcttctaagaacgcaaagcaaacatagtaccgagggtaagtctaagcacagt

SEQ ID NO: 477 - DNA, 433 bp, Homo sapiens
caagttgggatacgcctccacggaccccccacaagaaaggtatacctaccccactctgatgagctctctccacgagttccgtaaagtcttccaccttcccctccgtgtctgggtactggaacaacactccactgacatcttttccactgaagtccatttcacagggtaacttcagctcagtgaggactccagtatatctggaaagacagacaacaaagaacaatcgtgctttcggtttataagggaaaattaattaacgtttcttttccagtaagacagcattcattttctgtgccctcccacagtggcctcccacccctgcccacatcccgtcccacaggcacttcagtggtaactacatcacagcaactcaagcgcatccaacagctctgcttctgttcctctcttctatcctctgactcccctttgccct

SEQ ID NO: 478 - DNA, 418 bp, Homo sapiens
actgactcaacatggcccagttgaattcagatagaaatcaacatttgtgatcagaagaaatcagggaaatcataatcacaataaaagtagagaaacatgagcccctttaccttgttacccccaccattcttccaggcatcattctcaccaagctttctcggacagcaaaaaatgctgcatggggtcccccatagcccagtggcactccaaatctctgggagctgcccagggcgatgtctaccccaaattctccaggtggcctcaagatgcacaaagctaaaaggtcagtagcacagcaggccaggctctagaaaggaagtgagagaaaaggaacaaggttgctacctttccctgagagtagtgggagagtaggaaattatcttaactacaggaagacgggcagagtgtgttcacatcc

SEQ ID NO: 479 - DNA, 357 bp, Homo sapiens
aagacaatgagccttctacaccaataagatcttgccatttctggtgtgctcactgctcaggaggtggtgaataaatgaacaaatgaatgaatgaatgagtagctcatttctgtgtatcgtaaggcattcagtagtcaggtcagacgtgtgatttacctgagctgtacagatgttgctggtagccttgtctctccgaatgtgttgctccctggtttgaagagcaagacgatacacttctttcccagtggcatctctacaccaagaataaggcatccagttagcacagataatcacagcactgggagatgctataaatagaattacttctttccttcccagcttgaagtgaattcagca

SEQ ID NO: 480 - DNA, 429 bp, Homo sapiens
ttttcctcgtttctcacttgacttttaattttgcatatagtattggacatgcaatattttcaattttactcaaatttatcaattttattatgcccaaatgttttagacagattaccaactcaccttctgacaaaatcaaagtggcattatgtaccctcctagcaatatgctccagcccatgggaaccatggtagattgcaaacatggcagccatattcgccaagagggcctaaaagataagaacatttaaagaatcacgtgatggaggacaattagtgggagggtgtaattacttgacttgggatgtcaaaactgaagacagcgacaaaacaaaatgatcagatttcctacattctttgatagttggggacaattaatatataacctgcctgactacctgaaaggaaccatcatccaagacaccctgga

SEQ ID NO: 481 - DNA, 365 bp, Homo sapiens
gctcacctgctattggccaggtggggctgtcggctgccagcagtgcttatgctttaagtgcggagcgggtggctgcggagccaggcgcggcgcaggatggtggacagcgtgtaccggacccgctccctgggggtggcggccgaagggctcccggaccagtacgcggacggggaggcggcgcgcgtgtggcagctgtatatcggagacacccgcagccgcaccgccgagtacaaggcatggctgcttgggctgctgcgccagcacggctgccagcgggtgctcgacgtagcctgtggcactgggtgagcccaggccggggccgggggcgttgcatgagatcggggtctgtctcagcctgtactgcg

SEQ ID NO: 482 - DNA, 352 bp, Homo sapiens
actgcctctctctgcctctcctcgctggccgtactcagggtggactccattatgctggtggaagagggcttcagtgtgacgagtgtggatgccagtgacaagatgctgaagtatgcacttaaggagcgctggaaccggcggcacgagcccgccttcgacaagtggggtatgcaggtctagccaggctcccccagcccagtcaccaggaacactgttcattctgcctggggctcctttaagtgggggcgggggtggagtgttgtgttttcctcggggagacagaaaaattactgtcatttctctgaaaagcaagtcttaagctccagaatgagacaccgggtgtgaagagctg

SEQ ID NO: 483 - DNA, 357 bp, Homo sapiens
ggtggctgctactggtaccatcgtgcctccctgattcctctttctcttcctgacccctagtcatcgaagaagccaactggatgactctggacaaagatgtgccccagtcagcagagggtggctttgatgctgtcatctgccttggaaacagtttcgctcacttgccagactgcaaaggtaagagagggtgtggccttgggcatggcccccgccttgaggcccccttccacagacatctggcacctgctctcctgccaaagcagactctctgccttggctctggcacccctggggaggggagagatgggagggagactggtgctgggggccctgagcagatggagtctttctgcccgt

SEQ ID NO: 484 - DNA, 419 bp, Homo sapiens
ggggagagatgggagggagactggtgctgggggccctgagcagatggagtctttctgcccgtgcctggagctcaggggaccagagtgagcaccggctggcgctgaaaaacattgcgagcatggtgcgggcagggggcctactggtcattgatcatcgcaactacgaccacatcctcagtacaggctgtgcacccccagggaagaacatctactataaggtggggccctctggggtgggggtgggggtgggggtgggggtggggtggagggagggtccagtggccccaaggtgggttacagaggctaatgccggctgccccaccacctacagagtgacttgaccaaggacgtcacaacatcagtgctgatagtgaacaacaaggcccacatggtgaccctggactatacggtgcaggtgc

SEQ ID NO: 485 - DNA, 442 bp, Homo sapiens
gctggcgctgaaaaacattgcgagcatggtgcgggcagggggcctactggtcattgatcatcgcaactacgaccacatcctcagtacaggctgtgcacccccagggaagaacatctactataaggtggggccctctggggtgggggtgggggtgggggtgggggtggggtggagggagggtccagtggccccaaggtgggttacagaggctaatgccggctgccccaccacctacagagtgacttgaccaaggacgtcacaacatcagtgctgatagtgaacaacaaggcccacatggtgaccctggactatacggtgcaggtgccgggggctggccaggatggctctcctggcttgaggtaccacttggcttagtgggggtgaggcggtagttgggggagctgaggtcaccagtcctcatggttgctggggcctctgttac

SEQ ID NO: 486 - DNA, 448 bp, Homo sapiens
ggtagttgggggagctgaggtcaccagtcctcatggttgctggggcctctgttacagtaagttccggctctcctactacccacactgtctggcatccttcacggagctgctccaagcagccttcggaggtaagtgccagcacagcgtcctgggcgacttcaagccttacaagccaggccaaacctacattccctgctacttcatccacgtgctcaagaggacagactgagtgtggcctcagctcccacaagcctctgcccaggcactgctaggctctgtctggaagatggggaccagcagccccacaccagggccagcctctagagcagactacagctggggtgcagggatgtgggttccacagacggaagggtaaacaatatagtctttttcagttcctgcatgcattgtgtttatttatgtcagaaggatcaggctcccatgctgc

SEQ ID NO: 487 - DNA, 428 bp, Homo sapiens
acccagcacttcatcctgagttctcttccctccgctcaatagggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaaca

SEQ ID NO: 488 - DNA, 449 bp, Homo sapiens
gggctccggctgctgacagctgcgagcccgcgcgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggtgagcggccctccctgcagcgtgcccacgcgcttggccgcccaccctgaggtggaagctctggcg

SEQ ID NO: 489 - DNA, 445 bp, Homo sapiens
agcacttcttgttctgtttgtagcctcaaatcaacatgtaaccaaaagctgtgaatgaataatccaaacttgaagaaccccagattttattcaggaggagtaactggaagccataaccatgaacttccatatctgtcataggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggtaagatgaccctaaactagtattcaggatgttatgtggtactaaaagga

SEQ ID NO: 490 - DNA, 429 bp, Homo sapiens
gcgcgtgcgtgttatgttttctttcttttaaaaagaaattgttcttttgttgctctaggttgctgcagcaactggtcacacagtagtgttggtagaccagacagaggacatcctggcaaaatccaaaaagggaattgaggaaagccttaggaaagtggcaaagaagaagtttgcagaaaaccttaaggtaatttcttattatcgatgtcttcaagacaagtcctctgactgctttacatttgcagggcaatgggggatttctggctttctttctttctttttttttttttttttcagtttgttagtgtaaaactcatttttccataactttaaaccaatataataacataattactaaacattcagggggtactgattacaaaacaggagaagtaaataaccattttgttgggtgggatttgaggttga

SEQ ID NO: 491 - DNA, 430 bp, Homo sapiens
ccagtgagcccggtgaatgttctcttcttcctcccactgcattaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgagtatgtaacctctggacaatcttctttttttttttttttaaccttatttttgtttttcatttttattttttgtttttatagatttgtgagtacaagtgcagttttgttccatgcctatattgtgtagtggtgaagtctgggcttttagtatacccatcacccacatagtgaacactgtacccaataggtaatttttcaaccctcgccaccctcccaccttttgaact

SEQ ID NO: 492 - DNA, 351 bp, Homo sapiens
tgtgtcttctccctcattcccccaatgggtcaggacaacagatgtggcagtaagcagtcaccttgtgcattgcatccaagagtcatgctgttttgaaagaagagattcactctgatactcccactatattttctcttcacagacatacaatctttgccagcaacacttcctccttgcagattacaagcatagctaatgccaccaccagacaagaccgattcgctggcctccatttcttcaacccagtgcctgtcatgaaacttgtggaggtcagtgggtgtcagcttgtgtgtgtctgcccgctctgccagctctctcagtcctgcttttctgtgttacaccagccctgcc

SEQ ID NO: 493 - DNA, 394 bp, Homo sapiens
accgaagttgcttgctgacactctggtcataattctctgctttgcatttccaggtcattaaaacaccaatgaccagccagaagacatttgaatctttggtagactttagcaaagccctaggaaagcatcctgtttcttgcaaggtaagagtatgggtagcttgggaaggaggtagttcttttcttcttggaccctgacttgttcctggtagaattcttctcatagaatgatgtgaaagaaggagcattgtatactgcaagcttgtccacatgctgtaaagagcaatccgtgcctcctgttctagtttgtagacagggaaactggactcctaagccatgcctaaggccattatgtggatagtctgagacctgaatggagctcaggacaccagctg

SEQ ID NO: 494 - DNA, 393 bp, Homo sapiens
caggatctgtgcagtggggcatctgggtttgaatgtttttttaagtactatgattgttggataaattgtcatatgagatagaaataaggccatgctgcaaattttgaaaatgtacagcttgataaatgggggcaaacatgatccagggtaagaaggggcaatttggtgacttcacaaaagataccatttaatgaaaatttactagttttttgtttttctgtctcccaaaacaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcggg

SEQ ID NO: 495 - DNA, 442 bp, Homo sapiens
gcctcttggggccaaaggacatagtaaatttccaagggaaaagcacattgatccttgtcgtagtctactcaacagacttccaaacgtgtggtgattctaactcgggtttgggcttttctttaaaaggtatcttgactaaaaggtttgtgtgaaatgtgatgccaggggaatactccttacttgtaaaacccaaaaaactgggggaaagaatacatacaataactatacatacaaaagcagaaagcttagttttctttttaagaaagtttatttataaatcaaaaatatgctgtagcattaaattatactttaataaatgattccagagttggaaaatcccaatgtatttgaaagtagctgaagtttcaggcatggagacttctgtctccatgaacagggtatcagtactccaaaattcacctcagtggtgcgtagctttgaa

SEQ ID NO: 496 - DNA, 450 bp, Homo sapiens
agctgggactgtgggtgcatgccaccatgcctggctaacttttgtagtttttgtaaagatggggttttgccatgttgcacatgctggtcttgaactcctgagctcaaacgatctgcccacctcggcctcccagaatgttgggattacaggggtaaaccaccacgcctggccccattagggtattcttagcatccacttgctcactgagattaatcataagagatgataagcactggaagaaaaaaatttttactaggctttggatatttttttcctttttcagctttatacagaggattggatctttagttttcctttaactgataataaaacattgaaaggaaataagtttacctgagattcacagagataaccggcatcactcccttgctcaattccagtctttaccacctaaaaaacatataaagcacttgctcagcgttggaatag

SEQ ID NO: 497 - DNA, 391 bp, Homo sapiens
tgctcaggaaagaagttgagggcaagactgaattaagatacagatctagctctgtagatcttcaaagcctctgtgaactttgcacacagtaaaattcacaagggcttcctacgtagagtttaacttacttaacatccttctgtggagctccaaatttattcttcttgcacaggacctgaccatggtagagtcccatcaaggcctttgattctttggtcattacaagctctccaaatttctgaaaagtaaaggggaatgagaaaaggtagaacttcacagtctaggttatatggattccttcagttcaggttcctctgaagagcagaggtaatgcatgtgaagcctgagtccctggggatgcgggggagtttgggggttcagtgctgcagaa

SEQ ID NO: 498 - DNA, 366 bp, Homo sapiens
aggaaaaaggaatccgtgatggcaagaacaaacaaacaaaaaaacccaccaagccaccacaaaaaacaactaaccaagaaacaaaggacattctaactcttgcaaagagagagagcaggcttaccctttgaacacttgttgctgtcctcggtctagcgcagtgagggtggcatctttaagtatagtctttagccccttatccacggagacttgggcgatgcctgctcccatcagccctgcaccaagaatagccagatgcctgcaaggcaaggatgaaatgactttcggtaaactgatcttaatcatttcagtcaaagtggaagattgcctaagttattcaataaaccaactaatgcaggcacaact

SEQ ID NO: 499 - DNA, 350 bp, Homo sapiens
agcaatcatgagtttcctatagctcctttaaaaaaaaaatctctgtgttttctgttcactacactaggattcaagtacaacagccccttgcttaccgcttctacttcctttagcactctgtgcttaagactaaggtcctcaaacacagcttcaatcaccatgtcggccttttcaaaaccttggtaatcaagctgcccagtcaagttgctgaagatggaatccctttcaaatgatgttagagctttcttcttcactttgtcattcaatctagaaaaaacacattcctagttagatgggaagaaaaggaaactaacgtttattgaatgtccatgggccagagcacacctgtg

SEQ ID NO: 500 - DNA, 392 bp, Homo sapiens
ccagtgtttaggaaccacccgcatccactccgtaatccactgtctcttctgtactcaagctgtaagcctttatcagtgaatctgaagcaataaaacatctcagggtttttctctgttccgagtttaccttctcaggtcttttgctgacagcagcgatttcactgattgggagagcagatgtgttactggcaaagatacagtgatctggaatcacctgcaggggaaaagcatttaacaatgtgtcaggtaggcctgggagatgattagaggccacatcaaagctaatgagtgacacctgggcccagcccactctgtcccccacaactgctcagacagtagatgtcactcacccagacattgacggatcacctagggggttttgtgtcggggaa

SEQ ID NO: 501 - DNA, 416 bp, Homo sapiens
ccttcaaggtctgggatggctgggagaaccctgccacatcctagatactccccactcccaccttgactcagtgggacagtcaataccaccgtccatcctggagacaacccaggggaaaatcatatcaaagtctggtcatttgccccagaatatttataaacaagcctggaggtaaaaggagtcttattagaacttttcaaaaactctgcagctctgttatacagccccttaccttaaccacaatgatgaccttcccctgcttgagaccaactgctacagctgaagcactggtgtctttggaagttttctcggtcgtgataatctccagcagctgcatcttgtccacgggagagaagtagtgcatgccaatcacctggcaaggggaaccaaaagccaacagatcggagaatgcgggt

SEQ ID NO: 502 - DNA, 416 bp, Homo sapiens
actgaaggagtggaagatgccgcaaacactctggagagcaataccaacctggaggattcggatgacttcagacatcatgggcgcaagacacctggtagtatagaagccaggtccatcctgccaaggaagagaacatgagctccctggccctgctgctgggactgagtctgaaacactctacctttcccagggtcacttcaaagtcatttgaaagtcactgtaaaacttaaggtgacttaaaatctcaatcagaatccttaaaaatgaaattgcaggggaagccgtactaggggtagcctggcttgaatcaaacagtacagcagatagtttcatggtcaccttcaaggtctgggatggctgggagaaccctgccacatcctagatactccccactcccaccttgactcagtgggaca

SEQ ID NO: 503 - DNA, 399 bp, Homo sapiens
cgccagtgataagggctctgtgtttagaaaactttcttccacgagggcttctgtaactctttggtctcaggaactgcttagaactttgtaactaatggtgctagttatgtttccttgaggctactcacctaggaagcccttggacaccatctgtgtcagcagttctgggtttccacctccaaaccgctccccaaagactttgcccagatcttccgccacatgtttcgctacatccacaccaacttcatccaccagtgtggcggcacccacaggaaagccaaagcttgtggtcagggaatccagcttcttcgggtcaactccttcctgaacaggaagcgatgcagggacctcaggggaagggcagcccaaatccccccaaagggctccctgtactggctc

SEQ ID NO: 504 - DNA, 427 bp, Homo sapiens
tccacttggaaagcaccatgccagcatcaggagtggtcctcctgttcaggtatggtggtcacaaagaaaatggaagacagcaccatggcacgtgtatacctatgtaacaaacctgcacatgtatcccaggacttaaagtattaaaaaaaaaaaaaaatggaagaggggctgggaagctttgggctgtcagagaaagtcaatttccaggcattagccactcaaacggacttacacttcagacttaggaggcagcttcagactcgctaaaatactatccatgtcagaattcaaatccttcctcttcacaccctcctgatagatgtaaaagcccttcccagatttacgacctaaaacaggcaagaaaagggagtgttactatttgttctcagggagggagtgttactatttgttctcagaaccctggcct

SEQ ID NO: 505 - DNA, 449 bp, Homo sapiens
tgaggcctgctcactggtagaacttcttgttagggctgttagcatggtcagctagcagctggcatggggtgaactgttttccataggcagcttcatatttcttgagccggtccactatcttctgggcgccatacagatccacaaagcggaaaggccctgaatagagaaagaggacttcgttgaaggagacgcaacacgggctccaggctaaagtgagcttccttcccaacctgcgagaccaacctcccagacaaggcgggaagccaagcccaaagacggctccgatgtctccctctgcaggtgtggccaagatcccctcttgcaggcacatgactgcctcattcacaaatcttgtcaccaggcggaactggatgtcttcgtctgatgagctgccaacagaaagagatgtttaggtagaagaagaggaaaaggggaggaaagccagagcc

SEQ ID NO: 506 - DNA, 430 bp, Homo sapiens
tgtgtttggctgggtgcagaactgccctcaccacccctggccaccctggcctcttgggaggaacaggcagagaggtggcttcagatggctcttggctgccactctaggcctcggggcttatacaatgagcagtgggctctaccttccaacaggaagtgcaaactaattcgaagtcacacttcaccaggagggagagatggtcttggctgaaggcactttaatcagggagcaaacccagtgccggagtttgtcttctcgttactctgataaatctagacaccactctgttggagaaccagcactgccggcagctggggttagtgcactgactgagcgaggcatgaggcctgctcactggtagaacttcttgttagggctgttagcatggtcagctagcagctggcatggggtgaactgttttccataggca

SEQ ID NO: 507 - DNA, 354 bp, Homo sapiens
caggagttctgcccggaggtctgggatgccctcggccaggcctcacctcgggagcggaggatcctgaaggcagaaaagcggctgaggatgccaatcgcccggcaggccaccatcttgagctgaagaggacagcagtggagagcgcctctaacgggtgcggccgagcggaggacttttctcccgtagcctggcagccaggcgcctggagcactgcctgactaaaacccagatgccgagtggccgccggccccttagccctgcccctcgctcctggctaacatggccgaaaggtcgtattctccgggggaggacgggggcccggagaggagggggtggagtgcctggttttccagt

SEQ ID NO: 508 - DNA, 434 bp, Homo sapiens
actggctcccttggcaatctgtcaaagtttaacataactgtcaaaactgtaaattcatgtaagattactgccagattggtagatttggggaaatatgggatacatctttcccattcaggactagattcataatgcggttagcagaaaaaaactgcaaattaaatgagatacctttgaattgggagagttaattcgaacaactgccacatcccctttgactccatagttaatatgggttctggctaaaaagaaaagaaagatttatttgtaaacatatttattgcaacataaatccaaaaagcaatgtaagcatacacattaaaaagaaattaaacttactcagcaaagcagaagaccctgtaaaattgcggcatatataacctgtaagaaaagacatttcaaaattaatttgcgaaacaatttctgtagtacct

SEQ ID NO: 509 - DNA, 434 bp, Homo sapiens
cctgtgtcactgtgcccagcacttctactttcttttaaaaggagaaattattaggcctaagaaacacactattaaccaagataaaaggtgacttcaagtttcctaaaacttacttgatatcagcacctgcaataaagcagcctggctttgatgagataaggacggcacttctgatttgatcactagcccagatttcattcataacttctgagaactctgaatgtagctctttactcagtgtatttacctgccaaagggaaatatatacaggtaagggtttaaatttgaagcactggatgtacgtaccaccatcaaatgctattttgattataagaaatatacttatccggcagaaatatactgttagaagagagtaagaaatatcattctcccagcaagtcagtagctttctattcaggcagctttggcccact

SEQ ID NO: 510 - DNA, 405 bp, Homo sapiens
aggcaaagcagtagcctaagggtttacagctgatgaatgccaccaatgagttggacagtgtctcaataactttagaatatctatacctcaagtcctcctcccaggcaggatccattgatggcagccacaataggctttgtggacttttcaagtttctcaactattctctgtgcttcttgtgatagctgtgttacttcttgaagggtcttgcaagcggctaacatgctgcattatccataaaagtagagaacagagaaaaagataaaactataatttatttggttcaatacttattcactatacacttatcctatcatgcatcaatatttgatgacaaatcttcaaatagaaggttaagaatgattttgcttcaaatagcacaatagcagcaacatcatttctcca

SEQ ID NO: 511 - DNA, 390 bp, Homo sapiens
agtctgtcactgatcctgtacactcatattttatttggttttttaattctacaatgaatgcccatattatgcattttatacaagaaaacagatctaaagagggcatatagcttcacaaaggggatgttagactcaccattttgggcagcctttgtgtgcctcctgctcctggtaaggcccccagcaaaacttcaggggtacctaatactgtttttctgtcttttgttgctattctgtattggcatgaaatggcaacctttgaacaaatgaaagaaaattagaatgttagaaaatgtaacttagtagcaacttgagatggataagggtctaaagattatttataaagcaggaatgtgctcacagaataaactgaaattccttaggctggca

SEQ ID NO: 512 - DNA, 352 bp, Homo sapiens
taaggtctgactctgagatgtgctaacacttacccaggggttccaccagttggtcaaccagtcccattttctttgccctgtctgcacgaatgcttctaccagtcagcatcatgtccaaagcagcaggcacacccacctaacaggcaagcaaggatgagaatatagggggaaaaaaatcagggtgataattatatagtttacaaatcatcaaatgaacaaatattaaaatgagaaaagtcaagccatatgtttatgctatttgtcaacagcatagataagttatatttaatatactgatatacacttgggtaactttggggattagatacctctagctgaagcaaaaatgtct

SEQ ID NO: 513 - DNA, 391 bp, Homo sapiens
acatctcctacctaaggctgactttatgctttgagtaaataatgcatttaccacttcctcattttgaatctacagcaaataaaattaaattctcaggaaagaagctttgcctttgttctttaacaatgatactcactttccaccaatcccttgtctctctttggagagatcttcttatcagctagtcctttggcaaaagtaattgcaacttcttctaggtattctattgtccgttcctctggaggttttagtcctggtcctataaaaatgaatgcaacactggaatgcaaatcaggcttagaccagtcccaggtagtgaaaaacccagacttgccaaagccaaaggccctagcacagcgttccatttcagactggagactggtaggtggca

SEQ ID NO: 514 - DNA, 447 bp, Homo sapiens
acagcttgctatgcccttcccttatttttggtaaatactttaatagcagaattaagaaatttagtactcaacatacatggtccagaatggcaataaggaggagtgatctatataaaggaaggaaatatgagaaaagtgggaatattgggtaagactcacatcaattattttcagaggtgcaggataaaggcctttagtctgctttcgcactttttcttccacttttttgtaaacctgttgcctgacaaatggaatagtcatggcatacgctgtcaattctgtaaaataaaatgcttttagatatttactataaagagcctagattcccttgttagtttatgctctaaactctataaaaatgaagtaattctagctatctgcaagaactgctctttattctgatacacacaatataaatttcaacctaagcactaccttaaacatgct

SEQ ID NO: 515 - DNA, 381 bp, Homo sapiens
aaggcttgtggttccatagagttaaaaaaattcatttttttaataggaaaagatacagttaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtgtgttatgaatagagggttaaaaatatagttattcattttaatgtgaaagtggagtcattaaaaaaaaaatagaatcacggttttaaggcccgagaagtcacctaatccagccaccattctgccacaaa

SEQ ID NO: 516 - DNA, 418 bp, Homo sapiens
gagaaagacctccagacaggctgaagaattttaacattgtgctggttaacatttcagactgatggtgcatctgcaatgttaatcatggcggaggaaaaggctctggccatgggttataagccgaaggcatatttgaggtaaagtaaatgttcaaacaaatcatctctgatttctttattttattaccaaagctcacctctctatttttttacctagggattttatgtatgtgtctcaggatccaaaagatcaactattacttgggtaggtagcagtttgtatccttggactataatcacaagtatttgattgcctatgttttattatactggttaataaatgattaacactggtttattatttatttgtttattacactggtttgagagtatattaagccctgagttcataattggtt

SEQ ID NO: 517 - DNA, 416 bp, Homo sapiens
agcttgtccttatccctcactgtttatttattatcaatttctctgactctgcaacataagagtagagggcatgtctgtacagtttcactattttatctttaacatttcattaatcagtacagaaaaatcaaagaatgagtgaaaagacattagagtacctatgtaaaactcagtttggggaatatgaaggagctcttagtttaaaaattaaagttttaagatattacttattttttctttgcagaccaacatatgctactccaaaagttctagaaaaggcaggattgaccatgaatgatattgatgcttttgaatttcatgaagctttctcggtaagtaatttgaaagacacatatgaagggactatagtcataaaaaatgtcatccatatttgtgggagagagcaaggcatggtt

SEQ ID NO: 518 - DNA, 384 bp, Homo sapiens
agcgtagaggaacatgaataacgaggttcttattcgattattttctcttccagggtcagattttggcaaattttaaagccatggattctgattggtttgcagaaaactacatgggtagaaaaaccaaggtgagtttctaattttaaaaaatgcgtgaattttcaaagcacgttaataattggatcttagttacctgttcttaagaatatgaagggaaagcttctctttcttttgaagaattttgtctttcattaaagatatttatttcttagtgtaaaagtagaaattcttgtatttcattaaatatatttatttcttagtttaaaaatagaaattatttagcaaaaataaaattctgtgttttttgttccttgcattctgaca

SEQ ID NO: 519 - DNA, 365 bp, Homo sapiens
agagcctagcttgattctgatcttaagtaaacttatctttacatttgtgtctttgggggagccaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcaggtacgttacagtggtgtcataggaccctccagagagtcattttcttggaatgactagaatgtatgatttagtttgaaaccttcttaaagcaatatttttgatgacctgggggtggggagtggggagggataacag

SEQ ID NO: 520 - DNA, 388 bp, Homo sapiens
aggtggattcatcaccattcattgctctaattggactttgttttctttacagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatagtttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggt

SEQ ID NO: 521 - DNA, 421 bp, Homo sapiens
ctgcaatgtgaaaaccatgttggtgttcctatcataataatattattagatgaagaatagttgataagattaagttttaatgttttctagtagccatggatgaggttatcagagttcatagactacaatgtaaactacaaattgttcagctaatccaggatatacttttgttcttctctttttagattccagaatgactatcttgacttacccctttaaaaatcttcccactgcatcaaaatgggccctcagattttgtaagtttattattatttttttatttttagagattggatttggatttataaacatctcgcacagatactgaatggtattgctttttgtaaacagtttattttgtcttccagccataagacctctgagctgttcctcccagctacgagctgccccaggtacagta

SEQ ID NO: 522 - DNA, 444 bp, Homo sapiens
ccactgcatcaaaatgggccctcagattttgtaagtttattattatttttttatttttagagattggatttggatttataaacatctcgcacagatactgaatggtattgctttttgtaaacagtttattttgtcttccagccataagacctctgagctgttcctcccagctacgagctgccccaggtacagtaatttgtaaaataaatatttctgatttaaatgttagattccagattctatagtttgtgaactctgaataaaaaccaaaactaatttgctaattctcccctttttatgagcacatgaacatctctgttgccttcaaattaaaaaattataggtccaatcaataatgatactacattatttaggattaggcttgaggatgttaatgggaggctgttttctgggatttgaacctgctggagtcatggaggttcc

SEQ ID NO: 523 - DNA, 450 bp, Homo sapiens
gctcacttatggtttacaaactctggcttacgaatgacatcagtttaccatcaacctgttcttcctcatggcatctttttagcttcaactaattggcatttctttccatgcttctttgcctagagagagaatctgaccaacacagttgatcacttgtaggtagatgacactggtttctggttggctcctatatggatggatcattggtgagtccagtacctactctgaatctaatcagcttttatattgacttagggatgtgtctatggcttcccctttggcagggactgtaagcagggcaactccctttagaggggcctgtgggatgtccaaaacaacaacaacacaacaaataccccccccccatccagacaaacaaaaaaagtatcttttattgttaaagaggaaataggaaatttaaaaataaaagaaatagagggggctgtggga

SEQ ID NO: 524 - DNA, 438 bp, Homo sapiens
gtcatcagactttatatattttaattagtagtttttgtttttaaactttatcttaaagctgtccagaccaaaacgaagaagacgttagccaaacccaatataaggaatgttgtggtggtggatggtgttcgcactccatttttgctgtctggcacttcgtaagtatgacatgatcatattatttttttccttcttttaagacactttcaaaagtagtctttgtaaatgtaacccagtaggtaataatattgttagtggactaatatttggatagcagtcccatgaaattaatatagaataagtcaagacagtggtgaaataatatggcaacatttgttttttatccttctcatgaataagtctagcgtagttttacttgaaacagctctattttgaaaacctagaggtccagatagcttgcttccaacagagctgtcc

SEQ ID NO: 525 - DNA, 434 bp, Homo sapiens
agcaagctcaggaggagttaaggcttgctagacttttaaggatgacaaatagcgaagtcacactatttcttcatttgaaatgatggactgccttggatagtaaagttaagtgtgtttgtagcagcatgtgtttgatgatctctgggtatttcaaatagaatgaaaatttttcattgaagctctagggttttggtttaaattactggttttcgttccccagatataaagacctgatgccacatgatttggctagagcagcgcttacgtaagtaaatgcagtttcatttccgttcttatttcattaaaggcactttctccagtttttacacataaaatagcaatttgttcttattttagccatctgtactatacaaatttaagcagcttatgaatattgtcaatctttattttgcaggcctaacagtgtcttagcc

SEQ ID NO: 526 - DNA, 448 bp, Homo sapiens
tcaaggagcgcagtgttttgtgtgatgatctctggcactgccttgatgtgtgaaatgtttctttgctttggatttctacttccaggggtttgttgcatcggaccagtgtccctaaggaagtagttgattatatcatctttggtacagttattcaggaagtgaaaacaagcaatgtggctagagaggtgagtaaaacaaactttatgttgtttaaagagtgataggagaatcactttgaatttcaattaatagaagttactttacaaaagcctttaaaatctattgagttacatttgacctaaaatgtgattttacagcttgggtaatgtgttatttaatatgtaaaagaattctaatataaatcaaatgacatacactatattagtgtatatccatactttactgtaaatcaaataaattatttgagctggtttaggacattgtctct

SEQ ID NO: 527 - DNA, 350 bp, Homo sapiens
tgcactagaaaccagccagcaggaattttgcatatacctgtcaattaatggcaagattaaatattagtgaaccatttctgtgatggacttcatttgattttaaatattgctctggagaatgttaaactgaaaccgtttccagatgactatgaagattagtgctcaaagcatcatttacatgatgcccttcccttatagtgatcatttcattcactctatttcctaaaggctgcccttggagctggcttctctgacaagactcctgctcacactgtcaccatggcttgtatctctgccaaccaagccatgaccacaggtatgtttaaatggaaacagacagtacatgttaa

SEQ ID NO: 528 - DNA, 449 bp, Homo sapiens
tgacgtccatatggcaggaatgaaacttgtttttctctaacgtgttgaatgtgtttttagtcatttaagaaaattaccttaattcttctgaaaagttgaaaactttaattacagatgttgtacaaagctgataactgtcattcagctttttaatcaagaagcttaaattggaatggtatgttattttctgtaaaagatattcatgaagtataacctgtgccctgtaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgaggtaaggcttgtgtttgcagggcatcccactgcag

SEQ ID NO: 529 - DNA, 441 bp, Homo sapiens
accggttaacagtgtacctgctccttggatatctcctttcccagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggtgaaatgaaatgcttcatgacacttattagggagttctgaattgctcctaaaactcaaaaacatcccgagtgatttttccataagtatgttggttctgtttccaaagtattcagcctttattcttaaatatggatgcaaattttgatttatgttgtaacaataggttaacattttttaatgtttctataagagtgtccttttaagatctgagcac

SEQ ID NO: 530 - DNA, 438 bp, Homo sapiens
tggaatgttctcggcagacgcaaacttgactgactcaatggtgctgttctcaagttccagacactcgtggcaactagacagatggaggtgataatgctcaacggggccccctcccctgtcactgtccccagcaggctcactcccagaggcactgcctctcctttgtttgggttcttcaccaagagcctttgggtcatctctgccaacatgctccataccgtcctgctcaggcttaatctcaagagaaggttcaggcttcggctctaggatctgggcttgcttgtttgagacctgatccttaacttccttcagagtggagtcctgcaagtgcaccgctaaggcatgaataggagagagagacagaaaattaatcaacacttcttgtatgacacatagctcatctcaagaatctcatcaccctctctgcattctgggact

SEQ ID NO: 531 - DNA, 432 bp, Homo sapiens
tgaagacaggcccaacaccttccctccctgagaaagataggccatgaacttctggtacaggtcttcgggaatggactccctggtagcaatgaccaacagcagacagttgtccgtccacgggtctctgagagcactgtcctccagcaggtggtagagaatataactgtcaatgtccacacagtcggccagcacagaccggacctcgtggaaccggccgagggcttcctgggagtcggagcccacatagaggaggatgttgggtgcctttcccgtgaggttgactctcctcccttctctttcgggggaggtctcatcagcaacactctccaaactgctgctataatcgtagggaaggtctggaatgttctcggcagacgcaaacttgactgactcaatggtgctgttctcaagttccagacactcgtggcaact

SEQ ID NO: 532 - DNA, 450 bp, Homo sapiens
tccctcgcaaaaatacccacagatacccaaagatcaccaaatccatgctgccctgagtacctggcaaagaacagcttctcccccgcgagttccaaaaggcacatgcacaatcatcctgtccttgtcctcattctccaggtggccctggagcctgccggggctgagccggacggggccttcctggtacctgcagccactgctcaagacgctgagcttcacctcgctctggtcagccttggagaaaaccaagttctggactgtcttgtgcagtgcacccttgcttgtcacctgaaagccaccaaaggtgaaggatgaagacaggcccaacaccttccctccctgagaaagataggccatgaacttctggtacaggtcttcgggaatggactccctggtagcaatgaccaacagcagacagttgtccgtccacgggtctctgagagcactgtc

SEQ ID NO: 533 - DNA, 440 bp, Homo sapiens
aactctactagttggccctctcttatatataatcctcccccaacaaaatgaatatttgcacatcttgaagatgatttccaaacccgaagtcaaaacagaaatggaaaatcaaaaccaaccaaaataaaacaattaaagcaacgggtcgccactgtgaagagggccacgtcacagcgcgctctgcccagctgagcccacaactcacctccgcagctgacagcaagtaaagaggagttaaggcaggaacttgtttcatgtcacagctgaggccaagggttgtcagaatctctctaaggacttcgtatcttctaaaattgcttgacttgagcaagttaaaatcttctggagtttgcactatgttggagctgggaggtagttctaagtgcacctgaaggggaaagatagcactatgtaaactgagggcactcacaggcaatgag

SEQ ID NO: 534 - DNA, 404 bp, Homo sapiens
acaactctatcccctccccgtctattggtaagagaggatgatcaatggaacaggactcctctgagcagatgcagacctgctcacaccttacccatccaggagacgcatcgttgtgggggtcacttcggcaaacaaaattactttccccaactgcttggtctgcagattttggcgatagatctctaagttgaaatgttctgatgagaaggcctccatgttggtcaccacaggtatacaagatggggttatttctacttcagacacgtaggatgaaacaaatctaagagagagctggccggattttatttctccctcggagtccacatgtttcccaagccactgcataagaggatccctgatttcctgtgtcataaagaaagaaatgagatggtcgtaatttggca

SEQ ID NO: 535 - DNA, 402 bp, Homo sapiens
tccccaaattggaaagcccggaattcatgtaggtcacatttgccatcacaggcaaatgtccagtgattcataagcattatgatttgacagaatgctttagttctactaagggtgaaccttctgatcactgcttccctcttcctcttcctccattccaggcggttatgaaaacagaatctactaacttgagtcccccagatgatcagcacacacattcaatgggctcctgggccacaagagttgcagagtttagaaaacagaagtaacagcaatgatcacaaaagatgactgacctttgccctcggtctgccgggccgcgatcactattaagcccatttcctgcggtgtctgaaacatcagcctgccgaagagggggaaagaccggttaggccagacatggac

SEQ ID NO: 536 - DNA, 361 bp, Homo sapiens
actttgctgccagctgtgcaaagggtaggctgaggttctacagccaccaattatgcaagcacatgctataaacaagaataagccagattctgcatgcatcccagggacatagaaggagactgaactgtacctacctgatactcgggaatggacctcactgcttccacgacagccacggacatcagatgctggacaaacgggatcctctgtcccagctgggatctcagtggaatggagatgagcagagtagaaagagcacatcccacagggctcagccacacattccctccccgtcctggaacacaggccacagtgggaaacatgctaccttgccacgtggacagacgcagacacacgtcat

SEQ ID NO: 537 - DNA, 450 bp, Homo sapiens
ctttggtggttcccgtggtcacacacagaaaatgctaaaccctgtgaagtgctttcgaccaatctctctgcatctataccctgctccaaaactacaagactcaaagtaacctcatatgataatctgctcctgccaatgtaggcatgcataaaccgtctttatttttattgttttattaatctaaaaatgctgggggaaaggtttttgaaacttaccaataagtatataaaatgtttctcccatgagtgttgagttaaccagaactccgccgatcttcatgaggtcactgtaataaatatcgttgggccacttcactcgtaagttgatatcctaaagggaaatctgcacattaattaagccgtcacaggacacaaggggcccaggcaagtcactgagctaagggaagataagcagaaaccaaggtaacatgggcctcgtcctctcctcttt

SEQ ID NO: 538 - DNA, 363 bp, Homo sapiens
aggagttgaaaagaatgaagatgagccagcactgacctgtggacccagtatcggtaataaaggggaaggacgctgttgggccctttgtcctgaaactctttgatcagtttctccagcacagtcacgactctggcgatgagataatcggctcttaagggcttcagttctgccttgtgttgtttattgtattctgtgatgaggtcgttgatgcagatggtagggttactgttagtcacattaaatccacagcctggacaaaaacaaacaattgagcagctcagcctgttgatggcatcacacattcctctctgccacatggaaaaagttacagtcttgactgtcaacttcctccttccttgtcct

SEQ ID NO: 539 - DNA, 447 bp, Homo sapiens
cctgtgggagggctttccctaaactaaattttctacttcttaaccatctatcccagagcctcttcaaacaccaaagaaaacgacaacaaaacaaacctaaaaacaaacagaaacacagaaaaagaacaaagacttaacaaatgaattggaggaaaagaaaattcacctacaactctaaattagatttccagatgcatgggcacggacaggcagccgcgtctcggggacgcccggcattaccgccgtttggggaggatgaggtttctcagcatgtcgaaggagttgccgtccgggtgcacagtcacaacctcgccgccctcctggtgaacctggaggaagccagaatcgtccaggccaacgatggacacctttggtccctctgcgctgcccagatggacttgctgaccactgaaaaggaagaacagcgtgcggtcactgggaggtgtc

SEQ ID NO: 540 - DNA, 359 bp, Homo sapiens
ttgaggggaaaagggagggtccaggactccaacgccctcccgactctggcctgagagctgtccggcctcgcctctaagagagcagtcaccacgggccaagcccccaaccctgacagtcagagtgcctgcagggccgccgcctcggcggctcggggcacttacagcccggagggacgccaagcccaccagtcgccgcggaagcgccttcctcattgctgccatcttggcccagaatcccccgcggcagtccagctgggccccgcgtgaccgatggctcgtctggtgggcgcggccccgcccccgcccctccgccgtgacttccgaagctggctccacccccagcctctctccgttttgat

SEQ ID NO: 541 - DNA, 431 bp, Homo sapiens
gtctgtccctgtttggcctcctctactctcccctaacttgtgcagaggaatcacatcttgcatagctctgtcaactgccattgcacctatcacacgtaatactcaaagcagatgcttgaaaaaactgtttttttggctcatttccaactttaccttttcattttgtagtccatctcggggaccaacttccacaattttcacccgctttggtaaagtgcccatagatgaggtgctgacctttggtttaaaagaggaaacaaaaagtatgaggaagagattgccacaattcccagggagaccaatatgaaagaatggatctatcttcactaataatgagacaagaagaaatatttctcaccatttaattcacatttggtctattttagaattaagaacaaaaagaatatttcacttagtaacaggaacaagca

SEQ ID NO: 542 - DNA, 447 bp, Homo sapiens
gccaggggcttggaaacctatgttctcaacttctacttgcttcaaaggcaaatgcaaaacttttcatccctagagaaaggcctttcattgagggctagggctcacctggggaacccacttaggagacacaaagctggtggtttctataacagagagtcctgcttcagaaagcatgtctatcagcttgattttcactggagtagatacgatattctatagtggagagagaaacaccaaggcagcaaagttagtaacaaaacagcctcaaaatgcagtacctgttagttcaagtactatagataattttttgcagtggatgcagcttctcacctgaaaaggagttatttacatagaaacattattctgccatgcaggctttcccgtaagtaaatgtgtgttaatttataatcccatcataaacaaactgagagcaatgtgtgatggcct

SEQ ID NO: 543 - DNA, 450 bp, Homo sapiens
tctctaaagaagtggataatcaaaagagctaacatttattaagcagttaccttttatctggctcttgctaagcaatgtacatgcatcctatcttctgaaatgctcacaacttcaggtactatcatttagccctattttataggcttgtcaacttgtcaagatcacagagcagtgagtggcagggccaggtttgccccagggtctggctgacagacaagctattcagatggacatcccaggacaggggactgaggcgccaagacaaggcagggaccaatgccatcaatctcatttcaggagcccccaccaacaagctatcctcttaccgctgcctcgaagcctttcaaatttggggtcaggactgggtagttgatgccaggaaacttctgaatgcccttcaagacttcagtgtggtcacccatctaggaaccaagggagacattgccaagt

SEQ ID NO: 544 - DNA, 350 bp, Homo sapiens
tcctaggatttcttctgaccacacttatttgggaaaagatgtctaggtgtggagctcaggctgcccccacccaggataagaagtttgtggcaggaggaccacttgagtcagagtctagccccattccagaacggtacagaggaaaggataccaatgtgctctgactcacccccgcacagaaatattggctgactgcgctgccttcaggattgcgtcaaacctctgaaaactctcctctatggaacaattgatgttcttcttggtgaagagctctgaggcagctccaaagatgactacttccttggctccagcagcaacctgccaacatccaggtgaactcctttcagcac

SEQ ID NO: 545 - DNA, 449 bp, Homo sapiens
cagaggacatcagggttgtggcctttcaatcactacaaggaactatgggaactcctgggtaaggagcccctcctcagagaatcacctcaacgaccagactggaaactgaattggaggttttcaggctggatagaggccaggggcttcaaggactacatgttcggctaggaggggggcctctagggagcaagtgcagggctgtgctcacagcaggagcttaatgaaggagctgggtgaatgaatgaagtcaggaacctgccagaaagggtggggagaggaacctatgcgctcaggggcagacaaggtggccaaccctcaccaaaccccccgccctgacacatgcacacacctcagctactttagctggggagatcttcccttcataagggcagccaagagcacaggagacgtacctgtgggaagacaggggaggaatgaggtcagtgtcc

SEQ ID NO: 546 - DNA, 425 bp, Homo sapiens
cgtgacctttgggagaatgggcatatgcttttgattacctgcagggccatcaaggtgttggccagggcttgaccataggtgtcatggcagtggacagccagggcagccagaggcacttcctgcatgacagcagatagcatgtctttcatgatccctggggtgcccacaccaatggtgtcccccagggagatctcgtagcagcccattgagtagaacttcttggtgacctaaggaagcaagcaggcacttggaggatacagaatccaccagccaggggatccatgcactcagaagagggggcctttgcctgggcagaacacttctgggtatgacgcactcagttcctactggattacatgctcctcaccactccaactgggaatgatgatcctcaatctatgatcaggagactgaggcgtaagggg

SEQ ID NO: 547 - DNA, 440 bp, Homo sapiens
cccacacgtcctcaggcattcaactcctgggccagggtccgtaacaaagggagacttcagccctcaaagcctctcactcctcaggtctgggcaggaggtccttctgccaagcagctcctcctgcccttcgcctgctttctgccaggagagacctctgtgtagagctggctatgaggtacctgcaccatttaacctattctcatttccatgtccccatccatgaatcatctgtgtgtgcccctatttccacatcatccccagggcttcaggtgggcaaggggctcagagtttacaggtagcctgagccactttggagctagtttttctgttcagggcttgacagataaagtttccagcttccagaagcttctggagattcacaccctttgagaaacaagttagaggatgcggtaagtcatggtatgccctcaacaccaggg

SEQ ID NO: 548 - DNA, 422 bp, Homo sapiens
acccgccctctcaattttgcagagatcgtccctggctctgaatgagagaggaattcggacagggaagggggttctaaccgctgtgatgatgtcttcggtcttgagagcgatgtgctggaccccagcgcccccgttatagtccacatattcctgggggagggaaacaaggagaccactgtcatttgccccatcacccacatccctgaccctacaagagcccccagacctcttccctgctcccctctcccccagccaggggcggcctcacctggatctgggacttcttcttgccaggcgctggctcattgatgggcatcttgatggactcttcatagttggccaccacaatggatcgcagagagctatattccgtgtgcacctgcgtgtcatccacggaccagaagcggtggaactgcaggttt

SEQ ID NO: 549 - DNA, 375 bp, Homo sapiens
cccctccgggctgagacaatatttctgaaaagatgcaatgcagagctcatactccccccacaaggctgcggatcctgcctgggcctcacctccagggcatcaatgttctccttcaccttgatcttggccgtcttcagcttctcccgcagttgtttgtagtacgtggagggaacagataagaactccaggcctctctctctcaagtggcgaatctgtttcagagcaaagctgaggtcagccttcggcctccaagttcaactcccctagccaggtggaggtgctgggtcatcaggatacagggtccctatcctagctcccctcaactgccaggatgctgtgtggcctcttcccctttcttctctgtcatgggccccg

SEQ ID NO: 550 - DNA, 449 bp, Homo sapiens
gggaagttgggcgagttccagaatcagggggcgtggctgtgtggctgtggcctccgtggggtgggcggggcttacatgccgggcaccaccccattggtctccatgttggtgaggttaccccgcaggttctgctcctcctcgaaagccttgaacagtgagttgaagttgccggctccaaaaccctgtggcgggaaagagaggagatgagccaaggacccagaaaaccgagtgtgctagctgcctgtcccctcgggcctgccggggacaagcagtacctggtggttgtggcgctggatgacttccaggaagagcgtgggccggtcctgcaccggtttggtgaagatctgcaggaggtagcctttctcgtcgtagtccaccaggattttcagctcctaggcgggagacagggggctctgctaggggaggctggcacggtgagatccttggaa

SEQ ID NO: 551 - DNA, 404 bp, Homo sapiens
gcactactgccttatgcgcaacacaaacacagacacagtattggaccggggcacgctttaatcgggagggctggagcagagggcggccccgccgaggggcgtggtcagtgtgggcggagccttgggggccgagtccgctggtgggcgggacccaaggggagcagccagtagggaagttgggcgagttccagaatcagggggcgtggctgtgtggctgtggcctccgtggggtgggcggggcttacatgccgggcaccaccccattggtctccatgttggtgaggttaccccgcaggttctgctcctcctcgaaagccttgaacagtgagttgaagttgccggctccaaaaccctgtggcgggaaagagaggagatgagccaaggacccagaaaaccgagtgtgc

SEQ ID NO: 552 - DNA, 366 bp, Homo sapiens
tgagggtgaggttgagtccagctcagtctcggggagccccgggggtaaagctgagtgtgcaggcatgcacgtcatgtatccactccagtccttcctcttctgctctctgctgaaaccccagtctccctgcactccgacccccttctagactcaggcccctacatttcccacatttcgcctgcttacctttgcccctttgtcactgtaagtcgtctaaggagaaaaagaaggacagtgagacttggaggttccaacacaaggtgcttctggaagcgttactgaagatgtcccacccaaggggagatggccatggcacttaccatgattgatcttagtcaaacctcctactgggactagaggcctggg

SEQ ID NO: 553 - DNA, 447 bp, Homo sapiens
ttgcagcagggttcatgagggtcaaggggccagcatgggggacttccgcaagagagcccctggcccccctcagcctgcctgccctattgcctcaggggcagagaccctcctgggaagatagactgctgcctgcacattttgctgacagataactttcccgctggtgtaattaggattcagagtatctggcccacccctggcctgatcctccctcccaagggccaatcacagaccctgctggaggcctgcccttgtcaggcagccctctgccctgccgtctgctcactccagcaccttgccccggcttctacctgcttggcgttgccaacccagaaggtcacagagtggaagtggaggaatcggcctctctcaggctgcagaaggagagaagaggtgaggttgagtccctgaaagtgagtctagaaaagtgcgggtggagtgatgtcc

SEQ ID NO: 554 - DNA, 394 bp, Homo sapiens
ggttgggggctgtcctgggggtggtgactcaccttcccttgtttgattacatggctgaccacctcccgggaaccggtctccaggcccctgtaggctagaggttcaaagcccatcttgctgcagtagaatgacgtggcctgaatcacagggttgcagcagggttcatgagggtcaaggggccagcatgggggacttccgcaagagagcccctggcccccctcagcctgcctgccctattgcctcaggggcagagaccctcctgggaagatagactgctgcctgcacattttgctgacagataactttcccgctggtgtaattaggattcagagtatctggcccacccctggcctgatcctccctcccaagggccaatcacagaccctgctggagg

SEQ ID NO: 555 - DNA, 373 bp, Homo sapiens
caccaggtgatcgcccatctctgtggccggcagggagaggatggcactggagtctggagtctaggtcccctcacctggcttttagtctccatccaggccctgaacccagagcccacccacggagccatgcgtccaccctcccagaacccagatcccacccacagagccatgcgtccaccctccccgggcacctcacctttgttccaggggttgagcgctgaggagaggacaaacacaatctaagataggaggagaaggaggtgaggctagtggctcaggggggcatggggaggtgcacccatcggcccctccctgccgacccgaaacacccctgatggagcacaagaactcctggacctgggttctagctcct

SEQ ID NO: 556 - DNA, 353 bp, Homo sapiens
tgtgatgtggcatctgggcttgtcactgtgatgcagcagtgtccttccagccctgactgatggggtccccatggcagacggaggccttcctctctcagtccacccaggtgctttcttacctgcacgatgtagtcacaatcttccacctcgaacgcaatgtccttcactccgtcaccgtgtttcaccaggtgatcgcccatctctgtggccggcagggagaggatggcactggagtctggagtctaggtcccctcacctggcttttagtctccatccaggccctgaacccagagcccacccacggagccatgcgtccaccctcccagaacccagatcccacccacagagccatg

SEQ ID NO: 557 - DNA, 386 bp, Homo sapiens
tacgggggacagacttgagggacaatgtctgtgctccaaggcccatgggtgggatggtttgatggagtcagctgcggggctcctggcatctcagtggtgccgacagcaggaggggtgggggcaccaaagggaactcaccgtctgcagcacagcaaacttcaccttcccaaacttgtcttgctctacccagggctcccgcatgattttggcgccccgttcccgtgctttctgcagagaagatgggatcggggaattggtgagggctggagccttccagaacccttgcctgctgctcctgcctggtggcctctgcgtggtcctgcaggcccctccagtttctccagccccaggtaggaaccccagccagcttcagccattacccccaa

SEQ ID NO: 558 - DNA, 450 bp, Homo sapiens
ctttccacccacctctgccctgagggacactcacagtttaggaagtagggggtccatgaacgctggggcctcatatccaggcaagaattggccgatgtagttcatcttctccaccagggtgtgtgtggtgtccccatactacgggtggaaaacagcctggctcggcccctgggcacccatccccgccgaggacagagcacatttcatagcgctaacgtagccccgggttccaacctgcatctgaccctaaccagatgcgtgatcttgggtaagtcacttctcctttctgaaatgaattgcaatctgtcacttgtttgagagtttccgtgagggcggggacactgttttgctcatgatggtgtacccagcgccaagctcagtgcctggcacaggggaggtactcaatgaagcacctacttcatttatttcagtaggtcaactagatgaaga

SEQ ID NO: 559 - DNA, 414 bp, Homo sapiens
cgtgaggacccgtcatcttcacgcagagggagagggccaaggtctcaccattcggaggcggacaccatctcctgatcaggctggtttcccacaatgtggtcgatcatctccagactgcatttgggcctgggaagggaagaagatgggggtgagaaggtggctaccccccagattgctcccttctccatgacccctcaataataataatagctcacacttctgtttttggagttctatttttttgtagagatggagtctctacaaaaagagagactcttttttttgcccaggttggtctaaaactctggggctcaagtgaacctcctgcttcagactcccaaagtgctgggattataggtatgagccactgcgcctggactcacacttatgtagcatttactaatgggccggaca

SEQ ID NO: 560 - DNA, 424 bp, Homo sapiens
attcggacagggaagggggttctaaccgctgtgatgatgtcttcggtcttgagagcgatgtgctggaccccagcgcccccgttatagtccacatattcctgggggagggaaacaaggagaccactgtcatttgccccatcacccacatccctgaccctacaagagcccccagacctcttccctgctcccctctcccccagccaggggcggcctcacctggatctgggacttcttcttgccaggcgctggctcattgatgggcatcttgatggactcttcatagttggccaccacaatggatcgcagagagctatattccgtgtgcacctgcgtgtcatccacggaccagaagcggtggaactgcaggtttttcaggtacctgtagggtgggcggtggaacacatatgctctgagcgcctccagg

SEQ ID NO: 561 - DNA, 437 bp, Homo sapiens
ggagatggccatggcacttaccatgattgatcttagtcaaacctcctactgggactagaggcctggggagtgctgggccggagtatttaaccccaagcaggtcccgcccaggcctcctggcctacctgggggatggggtggggagctgagcccagccctggaaggttccaggcctggggacctctgatccagccgcagcctcattgaacaggatggtgttgccaggcccagagaggggcagtgacgtccactagtcagtgggaggcagagtcagggccagaagccaagggcaagcttttccaggacgctgggaatgtgaccattactgcccagaatccaaagctcagaagccaaggccggctggagtgcagtggcggctccagaactcttgcctagaggaaatttgagggggcatttggagactggccccaaagtcc

SEQ ID NO: 562 - DNA, 364 bp, Homo sapiens
acagacagacagacagatgcgccgcggagtgctgactttcacctcttgagcccaacggccacaataccaggcctacataagcatgaccctttccctcgaaaccgatctctttctcctagttccacggccgcgctgtcccggcccgtaaaggaaggcaagcaacagaggcaaagaaccttctaccttcacgctccgacacgctgctgccatcttgtcgccggccactccacgggatggggatgggggcgcgggcgctcgttgattggccgaggcgaagcggcggaaggggcggatgcgacgggccggggcgtctgccgctgccgcatgagacgtgggggcgtggcctggtacgctagtcctttgg

SEQ ID NO: 563 - DNA, 358 bp, Homo sapiens
ttggtgacctcatgcacaccctgggagaggagaggtgaccccacttacgtcggctggggcgaaaacgcagttgtttcctaacttcttggcttgggcctccccacccgagttgggcaggtccagaagcacagcagaggctccctgccccacaagtcgctccgccgtggccaggcccaggcccgaggctcctccggttattaccgccaccaggccctgtcaaaagggacatggtcagggtcagctgttacattgcccagaccatccccacgctgtcgcctgcctgttctccaggcttctgaggagaaggggggaggggagaggtcgtggtcacccctgcgggtaaactaggtgtgctgct

SEQ ID NO: 564 - DNA, 381 bp, Homo sapiens
aggcggatcacattgaaggtgcccatgagattcacctgtaggacagatggagacatgctataggacctgaggcagaagaagcctttgtcccctaaaaactttggggtcctccacagccagatacttcttactaccactatccctggagaacttccaaggccttacatcaagaactcgctggaagtcttccaaggtatgggtctggcccttctttaagttgtacgtcttgctagccaccgcgatgcctgcacagttgacagctacatccacacggccaaactttccttttgctagagccagagctgtttgcacatccttctcagaggtcaccttcaaagagagaagtggagaaggtattcatctcccagcacccactcttcc

SEQ ID NO: 565 - DNA, 389 bp, Homo sapiens
cccggatacctatgggagccagatcccgagcaatgggcagtgtcatgcccactattccccccttggaagcagagtatgcagcttgtccaacctggagaaagagtagaagtcataggtgggagggccccaacaagtcacttaggaggcataagtcttacccctgcccacacacctgaccctcgaaggcagccacactggcagtgttgatgatgaccccacgttggcctccctggtctggttcattctggcccatctcaccagccaccaggcggatcacattgaaggtgcccatgagattcacctgtaggacagatggagacatgctataggacctgaggcagaagaagcctttgtcccctaaaaactttggggtcctccacagccagata

SEQ ID NO: 566 - DNA, 356 bp, Homo sapiens
ctgctgctgcttaggtggtggataccttcccctctcaactgtccatggatcccacccaatcccaggtatgatggagagaggggatatgtctacctggggcaatggtcatcacccggatacctatgggagccagatcccgagcaatgggcagtgtcatgcccactattccccccttggaagcagagtatgcagcttgtccaacctggagaaagagtagaagtcataggtgggagggccccaacaagtcacttaggaggcataagtcttacccctgcccacacacctgaccctcgaaggcagccacactggcagtgttgatgatgaccccacgttggcctccctggtctggttcattc

SEQ ID NO: 567 - DNA, 441 bp, Homo sapiens
ccaaccctgtcacagccttcacatttcttccccatgccaggccccctagcacacaacactgcctacactctgtgagaaaaagagactttattaggcacagagggcgactggtaggcagttacaaaatggctactgggcttcctcccaagctggagagtagtaccccagggaaaggaagggcagaggagcgtgtgttttctctgccttctcccttcaaggctgcatacgaatggccccatccagccggatgacctctccattgaggaatgggttctcgatgatggcctgtacgaggtgagcatactcagcagggtcacccagtcggctagggaagggcacttggctggccaagaagttgcacactttctctgggaggctggtcagcagtggggtgccaaacagacctaaacaatatagccaaattcagagactcacccttgc

SEQ ID NO: 568 - DNA, 438 bp, Homo sapiens
cctcttggccctgctctctcctgggagatgaaaggaacctcctcttcccatgttgaatttcttcccacagtggggaaatatcattaagtaacagacaaaaggcctgaggagcagggtggcttactcggctgtgaaacgacacctgggctgtcacgcccctgcacctctggccagtcagtgccgtaactgtggcaagactttctgaagttgcttttctcctccctgggattctggccttcccacgctagcattttgccaccacacccggtggtgggatgaggaggtgcccacggggcctttctcctttctgacaggctcatgcaagcggtcctggaccacaccattccctacctgcacgtgagggaagcctttggccagaagatcggccacttccaggtgagccgagtgcttttgctgacatgtactcttcaactgggc

SEQ ID NO: 569 - DNA, 423 bp, Homo sapiens
agtaaatggtgccttgggagccatgcctttcggaggcagtgatggccacttcggggtgtcatgcgggctgtggaacagccactctgtggccctaactcccacacctgcccccatctccatcatcctgagtaaatcccatctcctctccatgcccctgcttcctcatccttggctgtcttgttgccattgctgacctgcttttggtaactgagagagtgttccagcatgttgacctgtgacatccctttgtgcccagttgatgcaggggaagatggctgacatgtacacccgcctcatggcgtgtcggcagtatgtctacaatgtcgccaaggcctgcgatgagggccattgcactgctaaggtgagggccagcctcagtcggggagaggcgggggcagtggaccagctgctgagacttgctgt

SEQ ID NO: 570 - DNA, 353 bp, Homo sapiens
tccctttgtgcccagttgatgcaggggaagatggctgacatgtacacccgcctcatggcgtgtcggcagtatgtctacaatgtcgccaaggcctgcgatgagggccattgcactgctaaggtgagggccagcctcagtcggggagaggcgggggcagtggaccagctgctgagacttgctgtctgcgtgcctcgcagggccctgctgaccccagcttcctcccgtaggactgtgcaggtgtgattctttactcagctgagtgtgccacacaggtagccctggacggcattcagtgttttggtgagtgatccccacttcccagtcccggggctccctcactcctggggcctgtg

SEQ ID NO: 571 - DNA, 352 bp, Homo sapiens
acacccctccctcttgctaccttttgctgcttttctttaatcaccctctcctcctgtggcctgtttctatatacttggcattctgtttgctttctttgttttgtcaatcacttcctttcttctctgcccaaaccctggttgcaggtggcaatggctacatcaatgactttcccatgggccgctttcttcgagatgccaagctgtatgagataggggctgggaccagcgaggtgaggcggctggtcatcggcagagccttcaatgcagactttcactagtcctgagacccttcgcccccttttcctgcacctagtggcctttcttgggaagtagagatgtggcggctttccca

SEQ ID NO: 572 - DNA, 431 bp, Homo sapiens
actttcagtctcttttctgggggaaaaaaataataaacctagcctagccaggcgtggtggctcatgcttgtaatcccagcacttcaggaggctgagatgggtggatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggacgttgcagtgagccgagcttgtgccattgcactccagcctgggcgacaagagcaaaactcttcaaaaaacaaaacaaaacaaaaaaaccctggcccttgtttcttccagtttctagaggtatcagctcctagcagcttatgaacacatatgcttgcttggccaggc

SEQ ID NO: 573 - DNA, 450 bp, Homo sapiens
tcttaacatcctgccaacttgccttccttcttccaggccatgcccctcaacccttcctctacactgaaccagtgaactatcaagctccccgcaaattcttcagtggctcccagcacctgtaagatctaaggcttggcaaggcaaatatgactctgatccccctgggccttccccttctgctgcttccctccttccctgctgaatgttcgtgttcttgttgcaaggagtcctcactgccatgtttctcatccctgtgcctttggtctggggcagctctggaagtccttccagcccttcaaactttctcttgcttcctcatctctaaagcctcaggccagggcctgcctccttcaggaagacctctcttctccaaccttccctcattcctctgtctccatctcatccatcctggatgggtcccctttctccttctccctgggcatatctgca

SEQ ID NO: 574 - DNA, 392 bp, Homo sapiens
gaggtcccaagcaacccaaacctagatcatcacagaaatgtcatgtttcttggaataattctcccctctctgtgtatttatccattcagtttctatttaccaattgtttactattcagttcaccaagcattattaggcaactactatttgccaggtatcatgccatgttctcaggagtcacctagaagagcccacaaactctggaccatgtttaatttcccttttcgtctccagcctgggtccatggatcttggagtgtgttcagtaaacatctgctcctggggcaataatgaaggtactattagagattggcatgagaatgcaacagggctctctgagtaggttccagtgaactagacactgcaaagggctgcaccacgatacccatccat

SEQ ID NO: 575 - DNA, 400 bp, Homo sapiens
tggggttgtggacagcgctaaaagagggctctctttcccctagggcagaccttttccgcccaacacccacctgggagggagggcgagacccgaggtcagacgtccctggagcaggtgagcactgcgagggaactgagatgcaagatcctcctgcctgaactcacaccccgcgtgctgctcccccaactcgcctcttggatctcagaccagaagcttcctttcctcaaaatccttctatgttctccaacgtctttgggacagagctccttggcagggtttacaaagcttaggtggccctacccacttctccagcctcatctgctgcctcacccctataccacagctctgcacctttgctgaaactggtactcggcgcttggggtgtcctcatctttcccct

SEQ ID NO: 576 - DNA, 448 bp, Homo sapiens
cgcctagggtgattggctgctgcagcccaccccctagccggtttggtgggcggcgaagcctggattggtggagctaagagctggctcagtttcagcgctggctcttcgtgcatggcagagatggcgactgcgactcggctgctggggtggcgtgtggcgagctggaggctgcggccgccgcttgccggcttcgtttcccagcgggcccactcgcttttgcccgtggacgatgcaatcaatgggctaagcgaggagcagaggcaggtgaggagactgacccccttcctggccccaaggcctccttcctgcctggtccccaaggcctccttcctgcctggtccccatcggcccagcgcccacccagccttggcttttgcccgtgggccgttgggagcgccagcgcgggggcgggacgcggggcctccgacctcgggtccagtcctctgac

SEQ ID NO: 577 - DNA, 429 bp, Homo sapiens
ctccttcctgcctggtccccatcggcccagcgcccacccagccttggcttttgcccgtgggccgttgggagcgccagcgcgggggcgggacgcggggcctccgacctcgggtccagtcctctgacctcggcctcacgtctgtggagtgaagatttgagaccgtgggacagtactgctggaagtagagaggaggagtcgaggctgggagagctcctgagagactgatggtgttttggtggaggattggccaggctacctaccgcttgtggcacaagggccctcaatctgtatgtagttcacttacacctgaacaggctgaggtatgcttctcacacctgggtggtcatcgtaatcaccagggagtcttttttgtataaacagtttgggggttttaaaaagccacagtgagctctcctgtcgctcttcagc

SEQ ID NO: 578 - DNA, 382 bp, Homo sapiens
tgggtagtggagatgctgtctgcagtggcatctgtttacctctctcctattagcttcgtcagaccatggctaagttccttcaggagcacctggcccccaaggcccaggagatcgatcgcagcaatgagttcaagaacctgcgagtgagttgggaggtccgggcagtcgggggcagtcagggagtggggctgagctgcactgctgcctggaagagctcacacagttttctggtaaatgaagcctctctaagaatgcagcccctctctctgaagtgtttgggtctcattgttccagccacatgtgactggctgccttcccctcaacacttattccactctgctccattctgttggcaggaattttggaagcagctggggaacct

SEQ ID NO: 579 - DNA, 429 bp, Homo sapiens
gaacctgcgagtgagttgggaggtccgggcagtcgggggcagtcagggagtggggctgagctgcactgctgcctggaagagctcacacagttttctggtaaatgaagcctctctaagaatgcagcccctctctctgaagtgtttgggtctcattgttccagccacatgtgactggctgccttcccctcaacacttattccactctgctccattctgttggcaggaattttggaagcagctggggaacctgggcgtattgggcatcacagcccctggtgagtatagtgtctttccctaaaaagaacttttcttatgtgccctttaagacagttcccaaaagaagcaggaagggaagggaaagattgtgcttaaagaaacccagaactgcatcttttggacctgtgaaagcacccattgattgtcagccca

SEQ ID NO: 580 - DNA, 370 bp, Homo sapiens
tacaaggtgcttcccttctgccgtcaaatgtaagattcttaatgaatgtcccgatttaatctgggctgcgttttccactcccttgtaccacaccactcacagttcagtatggcggctccggcctgggctacctggagcatgtgctggtgatggaggagatatcccgagcttccggagcagtggggctcagttacggtgcccactccaacctctgcatcaaccagcttgtacgcaatgggaatgaggcccagaaagagaagtatctcccgaaggtgaggaaatggaaatgtaatacacgctaatctcacagtgcaaccaccaactaaaagataccctctccccttgggggccagtcagacctgctttctgt

SEQ ID NO: 581 - DNA, 435 bp, Homo sapiens
gaggcagtaccagtgagctgctctagggtactctgaggttgtaacaaggcctgttgggggttttccttgcagctgatcagtggtgagtacatcggagccctggccatgagtgagcccaatgcaggctctgatgttgtctctatgaagctcaaagcggaaaagaaaggtgaggccactctcaacttgggagccaaaatgggcagaggtacagacattatcaggataatggagcaacaattgtgggtggcccctgctgggtttccagaactttctcaaaggtggacagcttcttgctcagcagaaggtctatggcctggctgagacaggccaagatggcttgagcaaatagccaacatcctgcccttaggaaatcactacatcctgaatggcaacaagttctggatcactaatggccctgatgctgacgtcctgatt

SEQ ID NO: 582 - DNA, 398 bp, Homo sapiens
aggtctatggcctggctgagacaggccaagatggcttgagcaaatagccaacatcctgcccttaggaaatcactacatcctgaatggcaacaagttctggatcactaatggccctgatgctgacgtcctgattgtctatgccaagacagatctggctgctgtgccagcttctcggggcatcacagccttcattgtggagaaggtgagtataggtgggtgcagggccaggaggcttctgcctcctgacagtggtaccagagatagcccgttcactgatctcaaatggaatcagtgttgtgtgctctgcaaggcccccagaggtgggggtgaggcagagagcagactgcaaggagggtgaccaaaagtccaggaagtccagggcagatgggtcacttctg

SEQ ID NO: 583 - DNA, 444 bp, Homo sapiens
caagctagtggcagaggaggctgggatcaatctggggcgttagcaccggaaggtcccggggggagcatgggactaggatgctgccatgctgtgcaggtacagggactcaataggaaggtgagtgccttcttcccagaggcctttcctttaccaggcccccttggggctaatctgtaaccaggaccaccttttgtttcctgtaaagggtatgcctggctttagcacctctaagaagctggacaagctggggatgaggggctctaacacctgtgagctaatctttgaagactgcaagattcctggtaagtagcaccgggaatcggggagcccctctcctgacccccttccaggctgatctggctgttctcaagttgagaaagcctctgggttagagaggcttggcattgttagcgcttcagtgacatgtggctaggctgtgagctg

SEQ ID NO: 584 - DNA, 400 bp, Homo sapiens
aagggagtccagagagggaagggaaagatctaacaactctagcctttgtggttggcctcgtggatggggtgggagtcctggcagctccacttctgactggaaggggttcacttgatccttttctttcacctggaaccttagttgaataaaggtcaagtgacatattttagtgccttacttgagagccatgtttccaaatctagtacctttgataaaagtgaggaggctgtggacagctctctccctctgaccagcacttatcctggcagctgccaacatcctgggccatgagaataagggtgtctacgtgctgatgagtgggctggacctggagcggctggtgctggccggggggcctcttgggtaagtgtgagaggcttgagggaagctgggctctgtc

SEQ ID NO: 585 - DNA, 388 bp, Homo sapiens
acagcctacactaatggcattcagcaacaaaatgtatattatcatagaatttgtataagtgctttagaaaatgtgtctactgtacttactttgacaagaagagagaaattacaaacagcaatgcaactaagatgaaaaatattccccagacgatctaaaagcaaaaatatattcattaaaatatagttctaaaagttgatattaaaagcacaaaatcattatattcaatatgagttgctagaatatgacaatgatctaacaaaaacaatctaagatacattttaacttagtatacaattccaggcatttatacctgaattttcattatgagactatttgattgagaacatgtacataaaagagacaaagcatttgaaaagtcttcact

SEQ ID NO: 586 - DNA, 399 bp, Homo sapiens
tgcaacaggatgtcagaatgtttgctagactctagcattttatactctagcagctacagtataaaatgattgatattttacttactgtttgtagtaaaggcaaaagcatattcagtggattactcaggttagctccaaaaattatgaaaccagaatctattccagctgaatgaagagctttatctaaactaaaaaaaattacaaagaatgaaatttatgttatactatcaaattttcagcaaatttagaaaaaatataatttaagcatgcaaatacacctgagtcaaagaaaacaatggataacaaattaaacctcacttaaatatctcacagctattgttcaattgatggagaataaagaaacactctattattggacgttttagccattctttgagt

SEQ ID NO: 587 - DNA, 359 bp, Homo sapiens
tgtcaacatgaagtgaaaaggctagtatttctctcacttgtggtataaagatacagctactatattctaaatctaagataatttgtaattatggagatcacacacaaaatgatgagaaaaaaataatactgtaatatatacttactctaatccaaaagaaccatatgccaatatttcgaattcctgccattgaagtaaaaataaagtacataataataattgttataagaatataatcaagagggaaaacctgaaaaaaaaagatgaaattaaatttaacatataaactataagcactctaacagtcatataaaataagctaaaaacttcattattctcatccggcaaatgtttacagt

SEQ ID NO: 588 - DNA, 429 bp, Homo sapiens
gtagcttagcaccatgggacccatttaagaaactactgtaatgaaattctgtgtgctgtttcaaaaaaacaacagtatgaaacaaatataaatatgctaaaaatagaaataaaaaaccagttttagcaatattaaatataatctgatgagctaatatcttatgctaaccatcacaattaaaatttcattttaaatatcactatctttaaaatatcaaaataatcaagtttcaaatatttcacttacctctattaagtaattttggcttccatacataacatattggggagcaagactataaatcatgtagctagtgtgaaggacaataagcagaagtatcatgcagagaaaaaggagtgcttggggcctggttctacctcttctgattttatataactggaaagaaaagagtgacaaaatttcagcaat

SEQ ID NO: 589 - DNA, 373 bp, Homo sapiens
acacagcaaaatgccaggaaattcttttcctaaaaagttgtaagttctaaaacaagctgtttttaccttcaggagcatctgcatcacatctctttggcacagaaagggttgaattgcctttatgattatcagaagttatattagtctgaaagataaaaatacagttaaaatataaaaaccgcattaataaatacatttggatttaaaaagtaatcactatgaactgtatactctgtatactaactacatctatctaacattccaaaatgtaaattttgtgcaacattgctcttagaagaaaaataattatggtaaattaaacattaaggctttttgcaataatcctttaggtcctgtgttgaacaacatggct

SEQ ID NO: 590 - DNA, 379 bp, Homo sapiens
ggaaggtcaaatcacgcgtgggatatctgcacttaccccaagaaaggcccagttaccaaaatagtaagcagcactgaagaaccagaacttgtgaaggaataggtatgtccgggtaacagtacactgatctgtgaaagcaaataaaagactatggtgagataggttctttcataaaattgatgattaatactttctctaaaagattattaaccaaagctaatgactaagatcatatggctagtaagtgtcagagatggtactgaaacttaggtctctctccaaagcccactctttcaatcaccttaatgtagtgttaaaaactgccaattaatatgacatattaaaaaaaaaatgaatgccaccaatgcaatccagatct

SEQ ID NO: 591 - DNA, 446 bp, Homo sapiens
ttccctcacaaagccagtagtcttatatttacatagcatgattatggtaatttaaaatgttaatctatgatacaatgttacttcagaaaacatataataaaatatagttgtcttatagccatgctcccatttttgatgaaagctagttagcaaatcctaatgttagtttaatactttaaaaatgcataacagatattcagtcagcattataaaacctttaagacagaaggctgtcaagcagaatagacagagggctcatcatcacttatgtctgaatcttcatctactccttcaataaccgatttcttccctttacaacaggatacaattaatccaatcaaaaatacctgtaaatttaaataagccatgtgttatttttcaaatttaaaatcatctggaaagtaatgctttaaaattcaatgacagtactatgatacaaatggcct

SEQ ID NO: 592 - DNA, 396 bp, Homo sapiens
ctcccttcctcccccagtccaaacatggggaaaactccaagcgcctcccctaccagtagtaagaggccgaatatgcaccagccgatcaccagctccgccgaggccgcgccagaagtcgccatcttcgcttccggtccagaccaacctgagcgcccggggtggggaaaggggagggggaaaggggagagagcgcgagatatactgcacccgcgcaccctaaaggttaaaggggcggagggggaggagcaagtggttgccaaggagactggacccactagcgtcccctggcggcgagccgagcgggggcggggcagcaaggactgctcaggggcggggcgcgtgcggacgcagtgacatcaccacgctgccctcgctggcttccctgcaagctgagat

SEQ ID NO: 593 - DNA, 350 bp, Homo sapiens
acaacttcactttcccgccgactttggtatttacgaacatatatccagcagaatgccaaaatagcctgaaatagaacaaaaagagatgtttgttactacccagtgtattttctctgatttttgtatgtgtttgaaagtttctagcaggaaaccttatgtgaagtaaaggttattttagttgtgtaaggaaagcccactatcccttaaaaacttgtccaagatgtataattttcaaagcctacttcatgaatgcagtacatcacgtatgcatacacacacaatactattaataacagtgctcagctacatatttcctcattaaacacagtgcaaacgttaatggtttcaca

SEQ ID NO: 594 - DNA, 383 bp, Homo sapiens
tatcggactgccaagtgtgccagaaatttgaaaggaaaaaaaatctgcaaagtaagattatatttaccttaaatgtaccattttgatttttcatgtaagaaaccaaaaatatatccactggtagaagtgctgatgtgataagtgcaattgctagagaaaaaattgctgttatggtggagacaacttcactttcccgccgactttggtatttacgaacatatatccagcagaatgccaaaatagcctgaaatagaacaaaaagagatgtttgttactacccagtgtattttctctgatttttgtatgtgtttgaaagtttctagcaggaaaccttatgtgaagtaaaggttattttagttgtgtaaggaaagcccactatccct

SEQ ID NO: 595 - DNA, 410 bp, Homo sapiens
ttggttagcagtccaaatagggaaagaaactgaaagatacttactatagtaaccgtataatacagtgtcctcaatctgtctgctgacattagcattagcccagtcctaggataaaaggaaacaatagaaatattaatgaaacacccatttgcctaacaattaaaagtcaagttttaatacgactgaatatcacttccaaaatctatccacccacataaaaacaatctatgtcttcaataagtgagagacagacaatagacaaatttcagtatgtaaatgctgagataagacaacacagttctgggaaaacacagacaaaaggcacctaactcagactgaagatgaggaatggcttctcaaaaatgactaaactgagacctgaaaggagggagaatgatctcagggaaaca

SEQ ID NO: 596 - DNA, 417 bp, Homo sapiens
ttctttcctaaactaaggcctctaaaataaagatacttacagtacatttactagtatcatcatcatccttttcttcataatagaagtagacaaaagggatccagaagaacacacagaacaatataacagaatataaagctgtggaaataaataataaaccgagctttactaaatacatatgtacttaatcatggttatctatctatatgtatatatattcacttaacaaattcactcccctatctgattccctcttctcataactctttctatatagtacatgatgcccaaatagccttttctgtcccatgtcccaagaaatcaacagtattatcagaataacaacccataattcaagttaactttacagcaatttctaacaatagtaataactgggtcaagaacaattgtggcagc

SEQ ID NO: 597 - DNA, 383 bp, Homo sapiens
aagggaggtgaactctgcttgcattcaagcacataaaaatgtctagatgaaacaacatagacaaaactgttaaattgtggctattgttccttggagatttagagagtggattgttcttttttcttacatttttttctttcctagatttttctgaatgatccttttattttttttttcaaataattctatttccatttcatggtttaaaaaaaaaaaatcaagacttacccaactaaaagaagcagtgcacaaatcacaacaaatcccaaagtatacttgagtgccgttttaatttgctagatgccaaggagaaaaaagtataacatttagcaagccctttaaaatataaaatattcttgcaacactttaacagtaccttcaca

SEQ ID NO: 598 - DNA, 449 bp, Homo sapiens
tcaggaaatataaactactatgttttttaaaaaaaacaatacttacgactacttccaagttcttcaaatagggacttcactttttcccactctgtagaatttttgttattgggaacattcaatggaacaaaggcactacaaaagagaaaataattgttttaatagctttaaagataaaaagttaaattaaatggtttgaaactcaaattatttttctccaaaacaataaataaataaaatctgtactatgcacagaggggagtgaaaagtttcttatctatgcatttacttccttgtaaatttaatagttgtattactgcattcagaaaaattagtttcctttgtaatcccgtatgttttttgcacttaaaatactttattatactttaataaagctggtaaaaaacaaaaaattaatatataatattttgagaatggaccacaggttt

SEQ ID NO: 599 - DNA, 402 bp, Homo sapiens
aggcaattttaactcaattatccccatttcacttactgtgtaagttatagctgccaacattccaatcaaggtcagagaactgatagaaaatgacaatgcagctaaaccatctgtgaagaaagaaaaactgttaaaaatgtacatatatactactcaaatccttatatttagcaaatcaacatagaaagctgagctgcttacacattttgaagaaataaaaaccaatatgtattaccgtattcttgaagtgctaactccaagtggagaaaagagtttctaaaggactctttaaaaattgatttgtaaaaaatctttctgactagctgagattttctttccttcacgtcttaaaattaagaggaaaattactggctaattattgggcccaaaaagagatcagca

SEQ ID NO: 600 - DNA, 355 bp, Homo sapiens
tggggttgacaatgtctaagtcatatcagaaagcagctctaagacaaagtagttttatgcttcccaattacaccaaaacatcaactcacttttgatttaatcgtttgaatgtgttgttctacttcttcaatgtcttcagtgttttccaaacgttcataagcagcgcttctagtgccttttatcagatttaaaggtaacgcagacatgccataggcctaaaagaaaaacaattgaaatgttttagaaataatgtttcaaacatattatacacaattttaggttaaaaatgtcttttaaagtcataagagtcagcagttgtgaaagagtacagtcactgaaaacatggtatatggga

SEQ ID NO: 601 - DNA, 428 bp, Homo sapiens
aaacttggggaagagtgacagcataatttttaaaaacttcatttaccttcaggggacgcagagcgccacaaaattttgtccaccagctgttttcaatgaattctaaatgcctctctctcttcttaagtgttcgtaacctttcttcaaattgttttaaggcgcgtttatcccttgctggcaaaggtcgaccatctttgctctgcaaataacagaacaaaataaaagttttaccattaacatcttaataaagtacccagcagatttagcagatcaggcaacaaaaccttttcaggatggacactctttaggcaaatttacaaactaaaaaaaacctgacaactgcaatatgacaataaacataggataaccaaggtcagcataaaaatgtggatgtgtgtacatttatgcctaccttcctcttgatccca

SEQ ID NO: 602 - DNA, 450 bp, Homo sapiens
cgttttccagtcagtccaagacagcctacttacccgggtgtccctctcccacagactccgatgtgaacatgaagactccttcacttagagagtggtcacacaagccatccaccggtccattcatcttctcacacttctccactcacgcttctttcagtgaacaattttgaggctgtgactttgcctgagtttttttttcttcttcttcttcttctttcaacccaacaggcttgtctttggcagagccacggggatcacttctgcctaactgcctgtgagcacgtgagaacaggcgaggactgctgagaagggagggagtggatggaacacgggatgtgtccctccctccagcttgccacagcttgctcctgagcgactcctatatatggaaaagcgaaagtgcctgaaaaatcatgtgagaaaattggaggagtccatttcctaagaggg

SEQ ID NO: 603 - DNA, 378 bp, Homo sapiens
tggaactgaggagtatggctcgtttgtcttatacccatgattaatttctcagtctagcccacttaggtctccagcagggagggatcgggtgtttcttaccacaggccaccttggcattggggtcttgcttgagatgggcatccagcactgcatcactgatctggtcacagatcttatctggacaagagcaaatatgggtcagaatcacaaaaatattcgggataacaaattgaaatcttaaaataattagatatcgacttttcagtttacatatcaacttatctaccagagggaaaacactttttttaagtataagaaattagaaatactttgaaatttttatttatttccattcctgcctaattttggatgacacgt

SEQ ID NO: 604 - DNA, 394 bp, Homo sapiens
tgacccctggaacctgacagacaagtgtaggagtgttttcctcctggtagtattgatgctcccatcgggctgaaaggcacgggtttgactcagcactggggtctctatcagcagagagcaacagggatttcagacccggaggcctgccctcacccttggctgagtcatcgtagccgatgtgcttgatggtgtccctcaccacccgctggtagtccaccatggccattgaggtgatctcaccacacagcagcaccatgccggtcttgcacactgtctctgaaagggagcggggagcgaggagagttagcagccaagtgccagcaaagggaagctcacattcccagacctctcacagtgcagacagaaaagacacaggaggggccttacgaggaat

SEQ ID NO: 605 - DNA, 354 bp, Homo sapiens
tttcccagccagctcaacacacagctcccacatgcagtgccgagctacctgatctcctgcccccacatcctcctcatttctgtccagatggacgcactgggcaatatctggggattgctgctccaaagccaccagcacgttgcaagtcttgaagtcaaagcctaggcggaagcaaagtgagcctaagtggggaacaggtcagaaggagggggccacaaacttcccaatggatggctcggttcctgacatgccatttggtgtcagcgtgggggttccctaactagccagggtctgtctaggcccacagctgaggcccaggatgggagaggccccgcaccttcccaccctatcatg

SEQ ID NO: 606 - DNA, 387 bp, Homo sapiens
aaagcttctgtctagggctctcctggggtaattcagctgctcacctgagtcttagagtcaggccgcagccaggggaggaggccggagcgcctgaggtctgccatccgggcgttgagcttgtgagcaaggatgatggtgaggggcatgcactcctctgtctcgtcggtagcatagccgaacatcaaaccctgtggcgagagagcaggctgagcggcgcccaccctagaccaagaggaccgcagctctctccaagcctgaaatctccctggtgtgtccacgttgattgggtgcctcctccatggagctttccactggcatgtgcaggggaaggacgtcatccctgacccccaacactctaggagggggagacaagcccaaacccagtgt

SEQ ID NO: 607 - DNA, 360 bp, Homo sapiens
tcagctgaccccctccaagctatctcttgaggttttcctgctctgagacataagcaaccccagtaacaaagacaaaccagggcttcgttcagagacaagaatgcacctggggacctccgatgacaaaccgcccactgggctgcaggtggtagacggtgtcttcgtccaggtacttggccggcaccacggccctgatgacttgctccttcagggccctgcgcatctcctccagcgtgatgtcttcgttgtgctgcacagagatgacgatggtgtggatgcgcacagggatgactgcgccattgtcctgcatgtactgaactgtcacctgtccatcagaagggtgggggagatactgtgagg

SEQ ID NO: 608 - DNA, 440 bp, Homo sapiens
atgcagctgagcggtctaccttggtgtagtccttcccagagaaggccccaccaccatgagccccccagccgccataggtgtccacaataatcttacggccagtgacacccgcatccccctgcagagggagagaaatcaagataagaagcagagccagcccctagatgctggagggggctgaagtactgtgatggcagctgaactgcaactcaggaaggatgtcctggggctgcccacagacattttcctaagaccccttagcccagaactctggactccactcccagctcagtcactgacaacatattgaaaacaggtaacctgccaaagcttcattagcaagtgcagaaggtgggccaggggttctctggggtcacagccactccctaatgcctttgttactgagtccatcacaatggagagatccaactgcaggcagg

SEQ ID NO: 609 - DNA, 421 bp, Homo sapiens
ccctaggttttcagagccctggccacagtgcccaacacaatcacacaatcacaacctttggcaaagcatgcagctttcccaccgggccaacatcccctcactcagggcagaactgggcaggggtcctccactgcaacaggacggtggtgggtggagggggcttacctggacaagcactctccggcagagccctgctttcaccagagacttggccacccagcgggcagcatatgcagctgagcggtctaccttggtgtagtccttcccagagaaggccccaccaccatgagccccccagccgccataggtgtccacaataatcttacggccagtgacacccgcatccccctgcagagggagagaaatcaagataagaagcagagccagcccctagatgctggagggggctgaagtactgtga

SEQ ID NO: 610 - DNA, 426 bp, Homo sapiens
gcctcccagttgctcagagatggccccactggagttggtgttgactgggccagcaggaacctggggcagcctcctttaacctgacaaccaggctttctgcactggggatgcactgtgctgtaccaagagctcacagaccctcccacttctgagaggcagaaacatcctcctttctgcctccctttcaggtgaggtgagcatctgggcaaggaaggagcaaggtcctgtgtaatagcagcgcatggcactttacctgacaatgacgcccggccggaggtcgaagttcttatgcaccacatccagcagctctcgctctgtcttctgagaggttccgtaggtgaagatggaaatggacagcggctcggccacaccaatggcataggaaaccttccagcaaggtgcagcgtcagggattgaagcctctgt

SEQ ID NO: 611 - DNA, 439 bp, Homo sapiens
actcttgacgggggtgccttttccactaaattaacattgccccagtctgagggagcagcaggagaacaccatgcccatccttacatcaagatccaacctccagcaccaggaagcccctgcctccagctggccatgatgatgacaggacaggctaaatgagagggacctggctttgccctgagggttggtgggtggggaaggcgatcagcagccaggcgtctggggaagaggagcatggccaccaggtgcctccagggtgagaccaggcccagctccccctggctctaaaatacaagcttcctgggaacctcccatgggaactcgcttcttccgaaatggccgtagcatgctgtcttctggtagatgggcttcttcaagtccaaatccctgcatgtccagcagaaaggaagggcattggaagatggaacaggagcagggt

SEQ ID NO: 612 - DNA, 405 bp, Homo sapiens
tgctagacagttctgtaagactcagggataagaatgtgtccaaaaacaataatgtactaaaaacttaaaaagagtgagacttttcattttctttcactttaccttgccgtactccagtttcaatcctggtggaagggtctgctcgaggagtagagaggtgcactaatgggcctgccacaggcatgaagttattgctaggatcttctgcatatattctagcttcgaaggcatggccctgcagagttatttcttcctggctcaaaggaatcttctctcctgctgcaatctggcaatagaatagtgtttcttatgaaatctaccgtatagcggctaccagacttagtaaatcaatggtcttgctttttttctaggtaaaatgtacatttaggttttgcaatgcagcca

SEQ ID NO: 613 - DNA, 408 bp, Homo sapiens
acacatcaaggtcactggcacggtctcagatcactcacattgtactgacgaaggctgtacctcagttttgtcaatgccgcctggcgatctgctgcccacacgaccagcttcgcaatcatggggtcataatgcacggaaacttcgtctcctgaaattgaaaaccacggtaacctcttcaagtcaaaacacgaaggaataaaatacaacgagcaagacattttgttatgtacatttcacgcttaatcctcataaacccctgcatgataaataacaacacaaatttattcatgaggaccctgaggttcagagggctttgaaaactcaccaggtgtaacgaggtgggccacccaacagcaccaggccctaacgtggtgattcaatggcacacaagctggctttccctgtcct

SEQ ID NO: 614 - DNA, 361 bp, Homo sapiens
ggagaaaagagaggtcagtgtgccatacagaaagaaaagcatgttcaatgatgatttgcaaaacttgacaagcagaggaaagagaaaagccttccataccatgtgcctgaagagtgaaagtgtcggtcatggctttctccttgaggatgagacccagggctgcctggcataaagactctttggctgcagccttccgactgagcaacaactgtttgtggtgttgagggatgaaatcagtgtgcacgttcccagcttcaaactctgggtggccagacaggttgagtaagaagtcaatgttggtgtgcagtccaacaatctaggaagagaataaacccccagttcctgctgagtggggaaaaca

SEQ ID NO: 615 - DNA, 361 bp, Homo sapiens
accatcaactctactacccagagccaatcaattctattatattggcatatttccctccaatgtttagcctaggcatttaaaaaatgtaactgactgatcatggccaggctggaatcctctttttcagattaatgtgatacatttctatgactcacatttctcttttaatgaaacattacttactgtttttaccatctttaagagtcatgtttctggtatacgagatattcagtcttcttccactgctagacgaaaatggagagaattgatctagaaaaaatttaaaattcagtaacaaacttatgagtatcaagcctatgaaatttacaccttacaaaagaaaacataaaatgcaagtgct

SEQ ID NO: 616 - DNA, 434 bp, Homo sapiens
acaggcacacactttaggggcttgtgaatgtctgatttgagcttttactttttgccaagtttttattcttaaaggaatcacagcccaactgagtaaacaatcagttagaaactgtatagggggtaatttccccaaattgggtctgaaatacaagcataagatattctcttaactacagtcataatagtcaaaggcttaagggaaaccagagagtgaaagaccctattcagtataaaagcggtcagattcagctctgcactgtagaacaaaaccagtaaggcttacctgcatgctataagacccatcatggttatacgttacagctatggctacatctttatggaaaaagggaaaaaatgaagaaaaattagaagacattcatttatttaataaccgagatataaagaatctcactctcaacctaaagacaacca

SEQ ID NO: 617 - DNA, 438 bp, Homo sapiens
acagttttctcccatgccccaggagggatattataaagaagagacattaccttggaaaataggtaaatagtgttttccaggataatcagcttcgctttactagcaactccattaacagaacatttcaggtaagtgcagtctccctcgctgtaaagattaccaaggacttggaaagttttatcttcaatctgaaaaaaatgaaaaataagatttttaaaataaatgaacaacactacagaattaataagatcagaatcaattcttcactattggtagttttaaaacataaaatgtgtcttaaacatatataacatatattttttaaaaagtcatggaacttttcccctattcctaaccaagatactttacatagaaatgacaggaagataattaaaagggaaaaaaaagttatataacttatccatagcaccataatgc

SEQ ID NO: 618 - DNA, 423 bp, Homo sapiens
tgcctgccttcaaaaacagcagtctttttcataaattaggtaaatgggtattttcagtgaggactgtaataaacaatttgaatctgtaatagatcctcttgtttttgtgaagtggatgctttccaatgagcaaggtttagaaagggaaaaggacataaatgacaagtttaacaaagccacgtattaaaacttactgaacatcattctacagatgtcatgtgattaccttttcaatggttccagtcataggagctaaggggccgccctgagtttcttgtgagctcacagaagataagtatttggggactggaatgtcaatctcaatacttccttcctagaaacagaaaacaaactgaaaaccgaatcaacatcctatcactatatttttactaatatacctgaggtaataattgtttcccagca

SEQ ID NO: 619 - DNA, 439 bp, Homo sapiens
ttgctcccaaagtcctcatagcaaatgaactcatgatttccttacctccatcttcatggcgatcataaccatgagggaatctcccgctttcactttgtctccagctttgacaaacaccttgagattcagtgtgacaggttaatatttgaaaacacagaggtcctagatatgttcatctgcttcattatagtaaccattttactgtctatatatactcataacatcatgttgcaaaccatgaatataaacaataaaacataaataaaaagaaaaaaaacaacacagaggtcctttgtggtccacagatttggtatataaacttacagagcagaagtagagcccatgtggttgtgccatctgccaaatgcactggtcaaatcagaggcctacagcccaaatatacaggtcaaatctgagacctacagcccaaatgcactgg

SEQ ID NO: 620 - DNA, 437 bp, Homo sapiens
cccccttcctaaaagagactaccttgtaaaaaatttgaggcagaaacaaacattggcttccaataaaaaataattcaactttattagtatgaaatattttgagataattagtgacccaaatgcatgattctccaatatgaaaggtgttcagcataagcatacaatcatttagtaaaactgctctttatgagacccccagaaaagctggaggcacttcctctttttggtggagagagaagacactacttaactggccatttccttgctggagtttattccgattcccttttgtctgattcttcctcctcaaactcgactaaaggagtgtgtctgttggcctgagcaccttctctgtagaacactttctttactgtgccatcctttggagactttatggtatgctgcagagacacatgacaggacaaatgatagctgca

SEQ ID NO: 621 - DNA, 411 bp, Homo sapiens
aagtgcctggggttttcctaccgtcctccccacaccgaccctgggttccgccgcacctcccaccgctcacgcgggtccgtgcacccctcgctcccgcctctgcccactgagccatggcccctccacccacctcggcggcaggagcaggctcgggagacgatgccaccggttcctctccgccgccaccagcagcaccgacaccgcagaggccgccgccatgtccctggagcccggccactccgtgactccccagtacagaggcagctgcgtcccacacgccaaacccgttcctccactacgaagcctcgtgacccccgccggccaccgtcggagcctgagcctacctttgggctgatccaagaatgtgagggcgtctccacgaacaccaatcaaagaccagagcccggcttc

SEQ ID NO: 622 - DNA, 350 bp, Homo sapiens
acacttccagtctgaagcaaaatcaaatagaacaacaaagtctgtcagtacctgtggctgttgtgtacttcatggttctttgcctccacacccatgtcctataacataaatccaaaaggaattacaattaaacagaataggcaacacaattgttctttcaaaagaatttcagtttcttaaaacatgaaaccttaagccaactaacagtgctttagtaagactttcttagtgggtagaaaactaatctagaactcaagagttagagttctggctgttttccctcgtactacctgtccttgaatgagtcacctagcctgcttgttcctgaggctggcataagaccacagtca

SEQ ID NO: 623 - DNA, 384 bp, Homo sapiens
tgttcccaagaattagcagtgagcagtttgaacttacctacttcaaccctgataacactagcaaatatcaactgtcatcataaagaacgaaaatactgacacagtaaacgaataaacgtaagacgtggcttccaatttttaacacataccatatctacatgcatggaatttctgtcagcctcactataaaccgccacagtctgtacacccagttttttggctgtgcgcatcaccctgcaggcaatttctcctctgtttgcaatgaggaccttggtaatgtttcttcctgtttaaaacaccatgaaaatcacacagaaatgttactggagagcaaagaatgagaatgagaatacgatcttaactggctgataaggactcgactga

SEQ ID NO: 624 - DNA, 386 bp, Homo sapiens
actggctgagaaatgagatgggacatgcctagtttacaatgataatccaataatcaaatgtaaagatcttgggaaaggctaaaaatagaaaatttctataagtaactttgcatcagttgcacaaaacgtattccttttgcactgcaaatctcttcacaaccctcacctgtgcagcagaggtcttggccacttgaatgattttctccatagataggtagctctgctgggagggagcggggccgatggaatatgcttcatctgcctgtttaagaaacatcacatgcttaaaagactttgtggctagtacatactcatacactatacagaactgcttcagggtcattttattattgtaaataaaaatgccactccctcaagaacagtgc

SEQ ID NO: 625 - DNA, 361 bp, Homo sapiens
atttcaactgaccttcatacagttatattttaaaagatataaactcatacctctttatacccatgtctctaattgcagatggaggagggcctataaaaataattccttcttgcttacaaagttcagcaaattccatgttttctgagagaaaaccgcatcctggatggatagcctagaaatgagaaataaaataaaaaatttactcatcagtgctcaactggcaacaccttaatgcaggtgaagctgtcttcctctgggaggcctctccctacactggtaatagtatggtctctattaaactctgtttccaaagaaatatctgaaatattcatatgaaagctctgaaggcttacctaaacca

SEQ ID NO: 626 - DNA, 408 bp, Homo sapiens
aataaggccaacccacctcggtgtgtctacaaacttctcgatcagcatagcatcatcattgaaagacttcttagcttctctccgtgctgactctaactgttcttgaaattcttgttctgatctaacaatcctcattccctaagagagaaaagatgattatgactacaacataaataaaacaaagaagacaagcctgaattggcaaacacaagcatgcacaatcttacttttcctcctccaccccggacggctttaatcatgacaggatagccaattctcctggcgtgttccttcaggcactggtctgattggtcctcaccatgataaccctccacaacaggtactccagcagcagccattatggatttggatgtgctttagagtgggaaagaaaacaacatgccccaa

SEQ ID NO: 627 - DNA, 363 bp, Homo sapiens
acaggacagaactgggaaacttgtaataatatacttatatactactacagttttatattttatagaatgtgcatgcattatttttataatttaatttttaaactctgagtcagaaaaataaggccaacccacctcggtgtgtctacaaacttctcgatcagcatagcatcatcattgaaagacttcttagcttctctccgtgctgactctaactgttcttgaaattcttgttctgatctaacaatcctcattccctaagagagaaaagatgattatgactacaacataaataaaacaaagaagacaagcctgaattggcaaacacaagcatgcacaatcttacttttcctcctccaccccgga

SEQ ID NO: 628 - DNA, 420 bp, Homo sapiens
tgaccctgttgtgtctacccccagaacatcaatctcctcctcatccccaataccacaggaggtcttttcactacactgctattaggcaacagttgtccagcaggagtttgaggggtgagagacaccagattcacagatttctgatgtgaaaatcagagtaagattcacattacggagaagcttacaaatttctttccaaggtccttaccgctggggcctcctcaatgatcttctgatgtcgcctctgcacactacagtctctttcaaacaagtacacagcattgccatggtgatcaccaaacacctggacttctacatgcctatataaaagcaaacatgtatgttaatatatttgttaggggtgataaatatcacattcgttaagctaaactgttaggcacaatcaccaggatttctcca

SEQ ID NO: 629 - DNA, 408 bp, Homo sapiens
aagttgtgtttctcttgccttctaaaacataaattaaacactgttacgtctcttccattagaagcaaatcttaacctacctgctccaacataatttacagctttagcagctctgactgcagcttctcccagcttttttcttacttcagatttaataccaggctatgaaaaaaatatgtaaataaatctccattagtagcttgccttactagaaattccattaaaattcaattcagtcaggtgccacataatgacgtttcttagtcaacaacagaccacatatacaacagttgtcccataagattataatggagctgaaaaatccctatcacctagtgacactgtagctgtcataacatcacagcacagtcattactcatgtgttttgtggtgaggctggtgtcaacaa

SEQ ID NO: 630 - DNA, 373 bp, Homo sapiens
tgcattttgactcactgcaccttgaaatcatgtctttaaacaggttaacatgatctatatttctgcaggtcaccattgaaccttctgaagagcctttatttcctgctgatgaattgtatggaatagttggtgctaaccttaagaggagctttgatgtccgagaggtatgtgaaagtggaactgtgagctttatgaccagctgtgagtctctttgtatgtgtatctatttgcaaagctaaagtttgttaagatatgttcatgcctagaaatagatgtggatctcagtaaggagtgacatatgtggcaatgatacctttccatactgtggatatcattggcacagagtaaatactgaaagaggggagtgggggac

SEQ ID NO: 631 - DNA, 435 bp, Homo sapiens
tcaaattctgtactggaagttttaatatttcaaattatattttccccttgactataaaatattatatattagttgtgaaaaatatagaaaatacagaaaagaaaaaaattaaattgcatataattccaccctctagagaaggtggctaatatttggatgttttaggttaatgtgtatatacgcacatttttatgtagttgagatagtctatacgtatatttttttgttttactttttctagtttaaattataaacattttcccatgtctttagaaattcttcatgaaatattttctacggctagatcttaattcctataatagtacttggcaacatggtaagtagtcagtaactattttctgaatgcattgatggatataatgttctgttgtatggatttatttaggcaataccccagcattgctagtgggtctt

SEQ ID NO: 632 - DNA, 416 bp, Homo sapiens
acgcacatttttatgtagttgagatagtctatacgtatatttttttgttttactttttctagtttaaattataaacattttcccatgtctttagaaattcttcatgaaatattttctacggctagatcttaattcctataatagtacttggcaacatggtaagtagtcagtaactattttctgaatgcattgatggatataatgttctgttgtatggatttatttaggcaataccccagcattgctagtgggtcttaaatcctggattttattgagcttcaagtgatacttcactttagcaaacgtgacttagttaattgtaaatttttaaatgaggtttttagtttaacttttaattaattataagcacaggaaaaaatggtacttaaactctgacatacttgaaaaatgtgttg

SEQ ID NO: 633 - DNA, 433 bp, Homo sapiens
aatttctcaaggccattgttgtttttcctcttaggtcattgctagaatcgtggatggaagcagattcactgagttcaaagccttttatggagacacattagttacaggtataaaggtgaagaattgaaaatacgaacattttctgctgctttgaaaatcaggaatctcttgtttcaagactttgatacacttgacatgggctttgttgttgagagcactacaaatgtgtgagccacttttaaaaggaactgctttataaacataatttgtagcttaatggcttcatggatccaaatagtttaaaatgttaatagctagatgctgtggtgtgggtccctatctgtgactttgtgacattagttgtataaaaaggttcttatagtaaaattagtagaaaatacttgtagttctttttgtttttctggataacaat

SEQ ID NO: 634 - DNA, 393 bp, Homo sapiens
accagagtctaggaccttaggaacaagaagattgtgacatgagctgttttataccatagacaaaatctctttgcattttaaacttggatctgatattaaagaatgtgtaaatatgcctctttcttgtgaattgaagcccttggaaaagcacaagacataaatcttctttgaactttcttttgaggatttgctcgaatatttgggtacccagtaggtatcgttggaaacaacggagttctcttttctgaatctgcaaaaaaggcaagtactgttaaaaatatttcaagattttctgttttaatttaacataacgttgaaggtcaaataatgagttaaaatttattgcataaaaatgcttaactagatgcctcagcaaccagaacactgtgtgcg

SEQ ID NO: 635 - DNA, 361 bp, Homo sapiens
tcccatcacccagaggctctctttctgatctttctctcaggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatataggtaggtgtcatgattttctctgaaacaaagaaacatgcttcaagtataaaatacatggtcagtttatttcaggtgtatttgaaatatagaatgccattcccagatctcaatcaattataccgtaatttgtatcatttggaggggtgaaatgaaatttaatgcca

SEQ ID NO: 636 - DNA, 418 bp, Homo sapiens
ggcaaacatgggcctctgaaaatctatgttgtatattgacttaatttgtttattcttccttttcttcccccagcccaagatttctctacatttggccaaatgctcgtatctcagtgatgggaggagagcaggcagccaatgtgttggccacgataacaaaggaccaaagagcccgggaaggaaagcaggtcggtgtcgttttctcttgtttctctctggttttgcctctcaccataaacaccctggagccaaggagcagcgtgcctggaagcccttggtgttcatggctggggacctggcgcacactgcctggccatatttagactgtgctgccctggaagttgttccagcaaatcacatgatttctgtcctttatctttttaaagccatttcatttggggtactttctttgtggcca

SEQ ID NO: 637 - DNA, 352 bp, Homo sapiens
tgttaggagagatgggatggggcactaacttgatactcatgtcttagcgtgtatgttaatgatcacttgtaatttatacatcactatgcacatgttagatgtaacattattattcatgacatctgttgtttcttttgaattgagatgatctaaacagggccagttgttcactgaagctgacttactcatggcctcttttcctttagttctccagtgctgatgaagcggctttaaaagagcccatcattaagaagtttgaagaggaaggaaacccttactattccagcgcaaggtgggggccagaacatcactaactctctgatgggtgcagatggcagtcagaggaacagct

SEQ ID NO: 638 - DNA, 450 bp, Homo sapiens
tggtggtaaattcataactctttttttgttcttttgtcagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctg

SEQ ID NO: 639 - DNA, 443 bp, Homo sapiens
ggctctgtcccttattggctgggtcagggggcgtggcgcggcttgaccaatcgcgggcggcgcgcttaggcacgtgtgtggacaggcctgagaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctctgccctctaccaggtaggctgagcgccccggtggcctggccgccggtgccaggctaggaagcaagtggaggaggggcacgcttcaacaactgctgctctcttgtccgg

SEQ ID NO: 640 - DNA, 350 bp, Homo sapiens
ggagagatggacaagtggggtggtgaagaagagcttgaacaagacaggcaggggtgaatcttttccatacgatccagtggcccagcgtggctgccacagatggggtggcccagtgtggcggccacacagagttggcacagaccactgttttttttttttttttgacctttattttggtaaaaaggaattgctttctaatatttctctcccctgtctcctctatttctgttttaggagaactacaagcagatgaaagcactagtaaatcagctccatgaacgagtggagcatataaaactaggtaaacacagcatttattccacagcttatgcctttacttaagatgtcct

SEQ ID NO: 641 - DNA, 422 bp, Homo sapiens
ttgcaatatgtgagctgcagagaaaatactctgtaatttatgtaactactagtgaattcagaacatagactctaggatatactctaaaatcagggatagattgatttttttttaataccagtttttacatttacttcagaaaattggcaacttgtaagttgagtgaatgattattagccttttctcagaggatatgttgaacttttaaaaagtgctatattttggattaagtattatgtttttctggcattgagacctttttatcgtgtcaatctaatctaatctaatcacatttctatcataggaggtggtgagaaagcccgagcacttcacatatcaagaggaaaactattgcccagagaaagaattgacaatctcatagacccagggtgcgtacatagccaagtactgactcagagtgt

SEQ ID NO: 642 - DNA, 350 bp, Homo sapiens
aatagattttatatacaacatgtgtatttgaaatattgtcccattgaggaaaaatcttttccttttccatgtgtaactgtttaaatgtgtagtttttaatgacattaattcaaacaacatcctttcttcgctttaggtctccatttctggaattatcccagtttgcaggttaccagttatatgacaatgaggaggtgccaggaggtggcattattacaggcattggaagagtatcagggtgagtattctacttgtgcttcataatgtgggttgagaagaagactttgatgaggcacaggcatccagcactcactttgcatattagcatgcgatttgtatgctatttatat

SEQ ID NO: 643 - DNA, 444 bp, Homo sapiens
gactgctgtctgctaatggatgttaatagtgatacgtactagaagttgaaggttgtattggggtatcttgtaatgagtgtaattagttttgaagaaatctcttaaattctctctccaatgaaatttctgcctttcagagtagaatgcatgattattgccaatgatgccaccgtcaaaggaggtgcctactacccagtgactgtgaaaaaacaattacgggcccaagaaattgccatgcaaaacaggctcccctgcatctacttaggcaagtcaccagagtggtaaaataaactattattagctggtaaaatgcaagatagtttggaaggctgtatgtattacatttgggatgggtattttataaacctgttgatttctcctgtaattataaaggaaacacaggttctttgctgaaaactctgggggaaagtaaacaagaactgt

SEQ ID NO: 644 - DNA, 409 bp, Homo sapiens
cagaggtgggaaagcctgatgggtttggggcaatgaatccttttggctgcattgggggtttggagaacgaggctctataacagtttagaaagacagggcaagttttttgtgaatgtgattaagaactgatgctgtcattgatacaagtttccctctgcgtagcacatttagttcatagagatgcttatgtttctcatttcttgtcttcagttgattcgggaggagcatacttacctcgacaagcagatgtgtttccagatcgagaccactttggccgtacattctataatcaggcaattatgtcttctaaaaatattgcacaggtaatttttcatgaataaagtgtacagtggtgctttttactcttaagtatctttacgaattaggtactctgggatggcttgaaagt

SEQ ID NO: 645 - DNA, 402 bp, Homo sapiens
ggccagtcttctctctgacagggagattgtccataagttttgtaaaagtgagacataagcccttcaaaatgttttgatacaagaagtcagaaaactatttcaaacatttagaggactttgtttttaaaatgatgttcagggaccaaccagtaatatcccctggtcactgcagtgtttgtgggattctggatcaaacactatagaagtcactgcatgagctgcatctcatgtgtttgtcgtgtgcttggattccagatcgcagtggtcatgggctcctgcaccgcaggaggagcctatgtgcctgccatggctgatgaaaacatcattgtacgcaagcagggtaccattttcttggcaggaccccccttggtaagaacataagaacgttggtcgatggaaatt

SEQ ID NO: 646 - DNA, 354 bp, Homo sapiens
ggagttgtgcatgttggggaagcatttttatatgtctgatggaccgatttcactgatgatttttatccttgttgtaggttaaagcggcaactggggaagaagtatctgctgaggatcttggaggtgctgatcttcattgcaggtgaaacagaaatggttgtttctttccgggattgagtgtcattttgtttgtttgtttaaaagaagttttacgtatttgtttccagtgctaaacttgccagaccacaccacagtttatttgttcttgatctgctggtttaatgttcaattctttgaactgtagagttgcatttccaagctagagcatcagccaagaaggactggagagacagg

SEQ ID NO: 647 - DNA, 350 bp, Homo sapiens
ttccttttccctgttctgacaagtttagtttgcttattctgtagaaagtctggagtaagtgaccactgggctttggatgatcatcatgcccttcacttaactaggaaggttgtgaggaatctaaattatcagaagaaattggatgtgagtacgatatgttcttatatcttttattttcctgaaatgcattttgactcactgcaccttgaaatcatgtctttaaacaggttaacatgatctatatttctgcaggtcaccattgaaccttctgaagagcctttatttcctgctgatgaattgtatggaatagttggtgctaaccttaagaggagctttgatgtccgagaggt

SEQ ID NO: 648 - DNA, 443 bp, Homo sapiens
actctcccgcccacatactggaaggtgcagagcccaaggcgcacagctctcggatggaaatgggactcatgcacaaggcaatccccgctactaagcggtggcgcttctggaaggcaccctctgcctaagtgacagcagctgctgtggaacgcgcccccgggggaggacattagatcaaggtgctttggccacgccgaggcctcctccgcccccgaccgccgttcccacgctccctgtcccatggcgaaggtcgccggtgcccggtattcacctacggcattcgcggctgcagccttcagcacccgcgccattttggaaagcaacccgccacgtcaagactagccacggaggttgagagacgcgcggcagagggcggggcgggaggcagagggggcggggacagaaaggtcaggggcgtggcgaaggtcgctgctttcctgcta

SEQ ID NO: 649 - DNA, 429 bp, Homo sapiens
agagagatttaaaataccaggcattaaaataattaaaatacctcgatgcagatgtgatgcattcctccagccttgtttttctgcagaaaacctgcaattggactgtcacgtcccaatggatgaagcagttccatcttggtatttcccaggttgacaaaaacaacagatactccatgttcaggaagagggaccgcttcacttacctgggcccccagaatattcttataaaatgctgcagccttttccaaatctggcactgctatggctacatggttgagtcgacccaggttccacacagaacctgtcacttgatccaagggctgtgatgtggaagaagctcttactgttggaatgggagcttgaagtctggaaaaaagccctgaaaaattgaacagccattgatatccttcttttgagaattaacgcact

SEQ ID NO: 650 - DNA, 351 bp, Homo sapiens
acatgatggaagcagtgaaggactcaatgtcatagtacattttgatagtatttgataggctttttcaggtcaattaatttagttgcttgcaaatataaatcaagcttgctccagttccacaaggactccaccacagtctttaggatggagaaaaatcactggttttccatgtgctcctattttgacctcttcacttagactgcggatcttcttttttttcaaatccatcacagctgcattaatattatccaccttaagaaagggaaataaattgaacacatttgagatcataaaaataccaacttatagtatcataagacttagaaaaaactttgagagctcatgcagtct

SEQ ID NO: 651 - DNA, 374 bp, Homo sapiens
tccatccatcacacacatacccttgtacacagctaacacattacattcaattaccccattgtagaagaggaataatttatttctatatgattttaataatgttccctaagtaattagtaatcaagattttcttcaaattcaaattaacaaatatgtttgttaatctaaataatatacatatttatgtatttatatatgtatatattttaatctttctgtaattcagtctttaactgtgaacttttacatgatggaagcagtgaaggactcaatgtcatagtacattttgatagtatttgataggctttttcaggtcaattaatttagttgcttgcaaatataaatcaagcttgctccagttccacaaggactcc

SEQ ID NO: 652 - DNA, 426 bp, Homo sapiens
cctattggccgcgtccccagccgggctcgcggcctcggccaatggggccggcgcgcgccggaagccggaagcgcggcagcggcggcggcgctccccctcggcagctgttgtggggcaccatgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtgg

SEQ ID NO: 653 - DNA, 400 bp, Homo sapiens
gcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggtaaggggccgccgtcgatcccccggcagcgcggactggccgccctcctcgagtagtcctcacttgccccctccaa

SEQ ID NO: 654 - DNA, 364 bp, Homo sapiens
gatctgtcgcacattggaggcctgggatttatcttctccttttcaggaaatgaatggggtgctgaaaggaatgctctcagaatggttttcctccgggttcctgaacctagaacgggttacctggcattcaccgtgtgaagtgcttcagaaaatcagtgagtaagtattacggttttcattttctttgtacatacatttttcatatatatttgtgtatgttttatattggctaaaagctaatctatctccattcatatgtacagtttatttcaagtctaataaaatccaaacacagtatttgcaaatgctgcggctgtcaccacacatgatactaagattatggaggaagacgaaagggcaccaa

SEQ ID NO: 655 - DNA, 449 bp, Homo sapiens
cccggagcctcacaaactccttttaaaactggggttaaaactggagcacaattttgtgtgtaaaatggtcattcactgtagttcctctcagtgggtgctgtttctcatgaaaatgactttctttgaattttccagaagagtccattaaagctctatttaaagaacttgtttgacttagacgaatagtatgaataggagtcagcagccgttgcttgtgaattatgcatttgtcttgtctctttataaattccgccccagggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggtacctgcgatggtcaattcgggacaagatgggc

SEQ ID NO: 656 - DNA, 437 bp, Homo sapiens
gagtcgcctcctccagagagttttcaaaacagagcagcttttaggctctgtagcctgaaccccagctggggagccgaggtctcttccagctccttcagtgctctgagaattgtcttctcgtcccagcaacaggcttgcctcgtgggctgcagagcggccaggccacccttagaaccatcgttggtgttttccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcaggtaagcgacacgcagggagccccggtcacgcttggcttccgtgtggtcaggtcagcgaacctcgtggggtgtcaggtgccatgagggacacag

SEQ ID NO: 657 - DNA, 443 bp, Homo sapiens
gcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagca

SEQ ID NO: 658 - DNA, 439 bp, Homo sapiens
cacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggg

SEQ ID NO: 659 - DNA, 447 bp, Homo sapiens
tgggggaaacactaggctttcaaattttactacttcagtattttagttatatatcgaactggctaacatgtttttctttcttctagggaggtcacaatcacattgagccaaaacgcatccagtgttttctccagttacaaataaaacgaatatgcccatgctgctaccacatcctcaccagcatttcctaaaaggccttttaagagcacctttccgatgttaccacttcatctttcactcaagtactcatctcggatcaggaatcccatgtgctcagccgtttaattctcttggactccattgtacaaagtggatgctgctgtcagatggcttaaagagaaaattatgtgtacaaacaaccttaaaggaccacacagaaggactttctgataaagagcaaagatttgtggataaactttatactggtttaatccaagggcaaagggc

SEQ ID NO: 660 - DNA, 381 bp, Homo sapiens
agtggatgctgctgtcagatggcttaaagagaaaattatgtgtacaaacaaccttaaaggaccacacagaaggactttctgataaagagcaaagatttgtggataaactttatactggtttaatccaagggcaaagggcctgtttagcagaggccataactcttgtagaatcaactcacagcaggaaaaaggagttagcccaggtgcttcttcagaaagtattactttaccacagagaacaagaacaatcaaataaaggaaaaccactagcatttcgagtaggtcagtcttttttgtgtgttttctcagtaaatatttttacaaattctctgtattctgttttttaaaaaaaagtctaaatagtttgcaatcgaatggcga

SEQ ID NO: 661 - DNA, 383 bp, Homo sapiens
tggaacccagggtgtttccttcctatagccccattactcaggaattaaagaaacagatttttatttgccattttaggacatgttgaaatatattaattgtggttttaatacattaggggaaatagaaggtagtctaatattttactcagtaaaactgatcgtagttctgatttcatttgtttcattgaattagaagatctctttccaccgtaggattgtctgggccccctggtgctggaaaatcaacatttatagaatattttggaaaaatgcttactgagagagggcacaaattatctgtgctagctgtggacccttcttcttgtactagtggtggtaagtatggctgattctttttcaattgcagaggtctgggggctttc

SEQ ID NO: 662 - DNA, 414 bp, Homo sapiens
aggaactggctgataattgacccgtaaaactgttccatgattataaaatgtaactgtatgttttaggatcactcttaggtgataaaacccgaatgactgagttatcaagagatatgaatgcatacatcaggccatctcctactagaggaactttaggaggcgtgacaaggaccacaaatgaagctattctgttgtgtgaaggagcgggatatgacataattcttattgaaaccgttggtgagtgtgatattctatttcataacaatgtactattttatgaatgctatataaagatgagtgacaacttatttttgttcattcagcagatatttgctaaatgtataattaaatacaagatatcccatactccctagaagatatgaatgtataggttataatctttaccctccaaga

SEQ ID NO: 663 - DNA, 446 bp, Homo sapiens
gcgggagagctgggaaggataacgggtttgcttagagggtaagatatgacatttaatacattcttcagaagtgagatgtttaaaggagtgaccaggttgactgtgtgaccatgagtatgagtaaatgaagtagaatggaaatggtcaatgtagttgagaaagtcaaataatggtgagtattttaggatatagttgtgatttacaatttcaggtgtgggtcagtcggagtttgctgttgctgacatggttgacatgtttgttttactactgccaccagcaggaggagatgagctgcaggtaattatttttattttttcccccaaaaatataaaatgtatatctctgaaaataaaaatttccaatgttgtgtttttgtaaactaagttgataatggtttagaaaatgaaatatcattcatgttggctaaaatacctgaatcaaaggca

SEQ ID NO: 664 - DNA, 436 bp, Homo sapiens
ggtgattcttggcatccagggcttaggaggatatggatgaaaagttaatgaaatgtatgactttcaaaatctgagcattgactagttttcccatttttatgttggttgtcattaaatgtttctgatctctttagggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaagcttgcttgcattctgtatctttcactctgaatggattgtgtacattagaagacaggatataagtcccaaactagacatataatcaatcttgcttctatgtgaagatgatagttttaaaaatcatgacaaagacggagtgtgtagtca

SEQ ID NO: 665 - DNA, 450 bp, Homo sapiens
agtaaaatggtctggttcttcccttttcgataggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatcacttgtatgcttatattttcagtaattattgtatggtgctcttgtcttctttgtttgtgacccatgc

SEQ ID NO: 666 - DNA, 446 bp, Homo sapiens
gtgacgtcagaacagcgtggagacgtcacctgacggttgccgcggtgacctcacggcggtgtgacgtacccatggcgacgacaccacgattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggtttcaatttttattggttcgcagttctcaccccagggcgggacactcccagggacttgtttcccattggtttaacggaaggagcgggg

SEQ ID NO: 667 - DNA, 350 bp, Homo sapiens
ttaaagtggctgcaaagaatttggaagaactttaaaatggtgtatgccatgagtatttctttgcatttttcacctgtccccaccctacctttgtctcccgttttggtgtaaatcttggggatcctgggtgtcttcgaggaaggctgtggcctaatgagaaataaacatcagtatctggtgagtggggatggcttacacagagggtcagctccttcagagggtcccagcttgctgcttgtaacctcagaggcagcacttaccccttactgcttagatggtcatctcttgttgatttctttcccctagatcctttctaatagcaaacattttgtgggcaagaccagagctgg

SEQ ID NO: 668 - DNA, 389 bp, Homo sapiens
tgcgagaactggccttttctccctttgcccacttggtcttgtgtctgccctcttctggaccccctcccacacacaccaaggggtttgtttgccttctctacccggctggctgactatctgtacctcccattatctgtcccgaaaatctcacctagtcaggcccgccatggagaaatggtagccaggaacaggtaagtgttaagaatagtaataatgaggagactcgcttgaacccgggaggcagaggttgcagtgagccgagatcacaccattgcactccagtctgggcaacaagcgcgaaactccgtctcggaaaaaaaaaaaaaagaagagtgataatagctaacattatttttacttgtgctaggcactgtcctcagggtgaaaca

SEQ ID NO: 669 - DNA, 450 bp, Homo sapiens
agagatcctcctacctcagtttcctgagtagctaaggctacaggcattcaccactatgcctggctaattttcaaatattttgtagagtcagggtcttattatgttacctaggctcctggcctcaagtgatcttcctgcctcagtctcccaagtagctgagattgcaggtgtgagccaccatacctggcctgtccgcattttacagatgaagaaatggagctcacagagggagagtaactagccccaggtgacacaaagagtaactggtggctggatgctgagtcccgtgatggccaccggggctgaagattcccagcttgggtgagatggtgttactcactttctgaagctcttcggcaaatgtatggcccttttctgtgactaattccagagcaaacctatgaagaaaaaggaaaaagaatttgcctgtaatgtaatgtccctaggccc

SEQ ID NO: 670 - DNA, 410 bp, Homo sapiens
gagccaaggagcagagggaactgccatgaggccatcacccaccagaccatggcgggaaccacccccgccgcccttccacctgggtgtcccgcagactgcttccactggctcagaaggtaccttccctcccaggagctacgagcaaggctaactgacccacccgtgggtccctgggggcctgggatcccagatggtgaccctaggagagtcccctgaccctagggccctctgaacacccacaggagtttgagaattacttaagtgagcctcccgggccgaggagcatggtgtcgccagggccgagccgacgtcctgcaatgtgcactggatctggggggcgacagaaagtgacagtcaagatctatgtgagatgggctggacagagacaatgtgcagaggcgccacctaat

SEQ ID NO: 671 - DNA, 374 bp, Homo sapiens
tgtctgtcactgaacctgcctgcagccgcccccggttaagcctgcccagtacctacaggcaggatgaaggccgtgagtggtgggagctggctggtgtacttgtcgatccactgctccagctccaggatgggccccgccttgaacgtggtatactctgaggagccaaggagcagagggaactgccatgaggccatcacccaccagaccatggcgggaaccacccccgccgcccttccacctgggtgtcccgcagactgcttccactggctcagaaggtaccttccctcccaggagctacgagcaaggctaactgacccacccgtgggtccctgggggcctgggatcccagatggtgaccctaggagagtcccctg

SEQ ID NO: 672 - DNA, 450 bp, Homo sapiens
ctcctgcccgctgtgcagaggcccctctccctctccccatctccgtcctcctctccctctccctcccccctcccccttgttcctctccctctcccttgggccctctccctctctccagccctcttaccgtctctcggcccggcggcacacggcccggcagaaatgcagcgccgagctgatcttgcctcccgactgaaaggagaaagggacattgcctgagcagggtgggaaaggtgtgcccactgcggacaggagctcctctgaagtccagccctgccccccaaaccgggcagtgttctgcctccaggagccctgccacggcacacccaccgggcacgctgctccagagtgggcagggctgggagggaccggtgaggacctggagggacttggggaactggaggacagcgtctgtcactgtgaaaagagggatttattcagagcccatgt

SEQ ID NO: 673 - DNA, 398 bp, Homo sapiens
gcctcggctttcagagaggaacccccaggttccacgcgagtacctgtttaagaacttggccacgttcgcatcggtctctcccatctggacaagaggcaccacactagaaagggaggagacactgagtcacgtgacattatggggctcaacaggctctgacctgggcctaaaccttgagcagcatttcacatcctgccaccgctcaacctgaacctgcacaggctcggccggcagtggagatgacaaatccatcacaggtgggtttaaacaggccatcggccccctttccaccagcacatcgcaggacggcctggccaaggagggatcaaggatggctggtgagttgagggagccacctggcctacaccacaccccagccagccagcttttgtaccact

SEQ ID NO: 674 - DNA, 446 bp, Homo sapiens
gcacagctccttctcattgcagcaatcactttacctgtctttcctgcaatgccaattcattcccacatccctccaagacccaggagagcttggggaagcagggtcagggacagaatccccaaagggtcacagtcccttgaggaaggtggcaagaggtgtagatcaaagctgagctgggacaaaaggctgctttgagcctctctgggtgagctcttcaggaaccaggaccccagaagggcaagctcctctctccacggccatcgccatggagggatcctccaagctcccactttctgtgatttcagagtccctcagactcggccgatgggtcatttttcatgtatattttctcttgattcccctccttcatggctgcatatctggctagcgtgaagagatagtcactgagtctggaggggcagagagagagaagcaaacagaatggt

SEQ ID NO: 675 - DNA, 440 bp, Homo sapiens
tcactcagtatactaacctcagtggcacacacaggctcacctgaaaagtgagggatgagagggaggcagcttcacatggcatgggccagaggccagcgcaggcacaggcagggccagaagggaaaggagtctgcagccccacagccttgtggagctgaccagcctgtgcttcagggctgaggaaagttcaataagggctgacaacctccgaggctgctgcccagcatgcgtgagagcttcacattcattacgtttactcatactcgactcaaacgcaacctcaaggccaatcctgtcccccttacccaatagctgaacttaattcatctgtagttcccacggcttcaaacacttggtcatctttgggtctcctttctcctgtgaaggtactagaaaaccctgtggaaaaaaatgtttagccacccaaattaagattctgt

SEQ ID NO: 676 - DNA, 436 bp, Homo sapiens
cgccacctgggaaactgaggtcgcctcttgcgaacacaaccggcgatggaggcggtggaactacctttctctagaagagacacgtacatgcacacccccaccgtgtagcttgccgggaaactgagtcttcctgatttcgtgtggctgtctccaaggaggaaacgaactacgcatcccaagatgcatcgcgcataggcaatatggtcccgctactggacccatttcctacctgggaaatggagtcgaagctgactcaaaacgtaacggcccaattgtccttgagacttcattccccagcaagctcagcgtgtaacgtgcgctatggagccgaaagtcgcagagctgaagcagaagatcgaggacacgctatgtccttttggcttcgaggtttaccccttccaggttagtttatccctcctgctgttctagggcgaaa

SEQ ID NO: 677 - DNA, 358 bp, Homo sapiens
gagatggaggctggggcaaaagtgtgaggcctgaaggttaaggtgtgggccaggctgaggcctagactggccctctccagcctggcctgaactttctgtttcaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagaggtgaggaaggctcagttttcccccagctcccaaacctacagctgcctccagttcctcca

SEQ ID NO: 678 - DNA, 424 bp, Homo sapiens
tcccctcatgctgacagtaccctctattttgtccactgttccagagcctcccagagctgcagatagaaatcattgctgactacgaggtgcaccccaaccgacgccccaagatcctggcccagacagcagcccatgtagctggggctgcttactactaccaacgacaagatgtggaggctgacccatgggggaaccaggtgagagggaaaatgtaaatagaggctgagatagactggtaaaggcctctccctaccaggtcccacattcctcagccttccctggatggatgtgacacaacccagaacaaattagctttgttctggatgggaggcagtcctgtcacatgcggttgtctaactgggtactcgtgagatcagaaaacttagtctgcagaactgtcttaggatacagggggcacagcagt

SEQ ID NO: 679 - DNA, 409 bp, Homo sapiens
actggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcccctggcccttgattttctcccatgtggaccctgatttatggtggtacttgctaggacttaattggctttggcaaagcaaaaggttttgagtacaagattactatttttgataatatagtagagatcttccatgaagataacaaggctcaaggaagttaggtttggcc

SEQ ID NO: 680 - DNA, 448 bp, Homo sapiens
gggacctccatgaccttgcttttcttcaccctctccccagcgcatatcaggtgtgtgcatacacccccgatttgggggctggtttgccatccgaggggtagtgctgctgccagggatagaggtgccagatctgccacccagaaaacctcatgactgtgtacctacaagagctgaccgtatcgccctactcgaaggcttcaatttccactggcgtgattggacttaccgggatgctgtgacaccccaggagcgctactcagaagagcagaaggcctacttctccactccacctgcccaacgattggccctattgggcttggctcagccctcagagaagcctagttctccctccccggaccttccctttaccacacccgcccccaagaagcctgggaatcccagcagagcccggagctggctcagccccagggtctcaccacctgcatcc

SEQ ID NO: 681 - DNA, 440 bp, Homo sapiens
cgaaagggtgcttgaatttccacatctgtacaaatgaaattgtataaataagtgtatttgcagtgcaaagaatgctaccatcttcaaagcataacataatttcacaccacttgcttcccttgacatttttgatacattatatctaacactataccacccaatgccatcataattaaacccgttctttcattcctaacattcccaaacgagtttactatgctgattcttaagagataatttactcacattggccatctccgctggagaagatagttcgcaaaatagctttcctttggtaaagttatttctgggaaagaacacaacaaaacagacgagtgatcgattaaactctaacaacagacaactgaggtaacgtccactcttcgaaggtgtgtcgtccaccacgtcaggaccaaagtccaagctctccccgtacccta

SEQ ID NO: 682 - DNA, 378 bp, Homo sapiens
aggcagagctgtgattcattttcaactgaacaaacacaactttagaaaaatccattaagccttaagaagaaatattagaggaaaatacaactaaaaatgttttgaaacaattataagtaaagcagtaacaactttcacttacatatatctggaggtgcagcagccacatgagactcatccgaacctgatgatcctgcagtcgaaaaggctttgggattgacaacccttttaactaaagagcaaaatcctgggagataggaaaccagtctggctctgttacaaagcacctagaaatgacacaaaattaaaactatttgttctgaatataaatgttatacttacatagacaatctctggcaaatcttcacactgcaaggt

SEQ ID NO: 683 - DNA, 417 bp, Homo sapiens
aggacaatgccaagttttccaaagctatatatgctgtttttgtatatacatgtactggaattaaattgattttttactttttcaacaaaagtaatatgcttataataatcaagtcatatagcattaataatcaggaaagcacaataaatgttaccaacaatttacctgaaattcattcacatattgtgccatcacaaactcatgtctttcacttgataaaggttctgctagaacatcaggcaaagttttatgaaccaggcttttcttctgtgaagcagtcccattgaggtgacaatcaaaacctatgttcccaggaagctggaacctctgatcttgaggtccaaagggtcccatagtttcatcaggccacactgttcgagagcctgaagagaaacaacaaaaggaacagtttctcct

SEQ ID NO: 684 - DNA, 387 bp, Homo sapiens
tggccatgcaatcatttccagccagatacggtaaaatataatattaaggtatacagcgttccaatttctatagagtacattattcaacatattaaaaaaattagtaacagtgtttcaaagtataaagcatgacataccttttcgcagcaattctggacatgtctgtattgcacactctactctggcactttcaaagtaagtttctgcactgttaatttcttgttcaacaggtgcatcattaccctaaggggaacaaggatataagtcaacaaaatctggagttcaaataaaacggtatcttgcctgttataaacctgtcttccttagaaagctttttgtttgtttttacaaaaaattataatctaactgggaggtgaggtaataaca

SEQ ID NO: 685 - DNA, 433 bp, Homo sapiens
aagggtggaaatgacagtcatcattttaagacattggttcactattacttaaataatgaccataaaattaaattattagcaattgaaagaattaccttttctaagagcacttctctttcaatttctacttcttcactccaaacagtcatatcattcttagttttttgtgttacagtcagaatcattagtttgccattagctacttctggaaacagtgattcaaaatctacaaataagaataaacattccaggtagaaaagaatttgatttttaaagaacaaatttttaaagaaggataaaagtacttctttagaaaaatgctgattaagtaaaattactgtggtattagttaatttttataaatgtatgttatttttgaaaagggtaaaattcacttagttttgtttacttctgcttttgttggatgaactga

SEQ ID NO: 686 - DNA, 401 bp, Homo sapiens
acctggtaaatgatgtacagagttaaacaaggtacttgcttttcattatatactcttctctgttttttgtatagtgtacaattactactaccatgtgcatatataaaaattttggtcttaccatcctaatttataagatattttattagctttatcagaagtctaagtagtgaaaagacagtaacaaatattaagaccagattacaatgttgaaataaagaagagatcatgaatgtttaaaaacaagggcacatagctactcgggaggctgaagcagaagaattgcttgaacccgggaggcagagattgcagtgagctgagatcatgccacagcactccggcctgggcgagagagactccgtctccaaaaaaaaaaaatcaagggcacagttccacttctg

SEQ ID NO: 687 - DNA, 420 bp, Homo sapiens
actgtgagtgatagaggtctctcaaaagttgagaattcaactgactcacagtagtatttctttgggtaaaattgtgagatttttaaaaagtcttaatctattaccaaagttataaacacattttataataaaaatcatctctacttcatataatctgattttcaaatgataattactcactgccaaaccagatgatgggtcaataaagtcagcccaataaccctcagctcgaagagcatagcaaatttccttagcaccattgatgaactgcaatggaagtcacaaataatatgcttaagatagcattactagagattgttttatttttaaataaaattttaagtgactatcttgtttcagaaaagaactcaagattaataaaaaaataaaaaccaatggcaaattagactgtaaaggcgt

SEQ ID NO: 688 - DNA, 429 bp, Homo sapiens
tcccaaatcacttgccaatgttgtaaattcataaatgctgaaataaatacttagaaataaatatattttaaaaactttagtctgacagtgtttatagatcaacccaaatattacatacaaatagtacagcaaatgaatggatatttctgctaatttccacttaatttcttcataatatggctgtctggtgttgcattagtgaagatactccctacaactacatgggtaccccagagactatgacgaatcactttacagcatccaaggtcatcaacagagaatcctaaatgtcggtagcgttcatcagtttcaaaaagagtgttgtttgtatatggtccaaaaaactgaggaaataaaaacgaaatattctcattagtaagaaagacattttagtaataatttttaggtaaacatgaacacctatctact

SEQ ID NO: 689 - DNA, 447 bp, Homo sapiens
agaaacttaagaatcaataatggtatttaaaaaatactgtaatgaaaacacacattattgtaaccaaatgtgtgatttattttgggaagaaaataattaaaactgaggcctttttccaataaagaggagaaataacaatagcagatcataccctggttacaagctaattaccacatcctatacaatgtggatgtgttcaacgtgtattcaatgatatgaataaatgaacatttgcaattttaaaatcccaaatcacttgccaatgttgtaaattcataaatgctgaaataaatacttagaaataaatatattttaaaaactttagtctgacagtgtttatagatcaacccaaatattacatacaaatagtacagcaaatgaatggatatttctgctaatttccacttaatttcttcataatatggctgtctggtgttgcattagtga

SEQ ID NO: 690 - DNA, 363 bp, Homo sapiens
catgggtgagtcagagctgggtgtgccctgaaggctgggtccagtgtggccttcagcacacgcttgggacttggtcccaatccctccccacggttttccaggtgggcggggcaagcttgcccccggctcctttaccttccagaacatgaagctgacgggatccactacggtgggctggatgatctctcgcccagggaagatgccccaagtgacagcattcggctgcagttcaggggcattggtgatgttttcaccctgaggggatgtggggtgggggtaagacctgggccaagaacaactggagtcccactgcctggacagccttgactcaatgaggctgtctgggctcaataccctctgcct

SEQ ID NO: 691 - DNA, 442 bp, Homo sapiens
tcttgcctctgtgtgtgtgtgcatgtgtgcgtgtgtgcgggggtatgtgtgtgtaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcc

SEQ ID NO: 692 - DNA, 439 bp, Homo sapiens
cccccgacacatcaagacacctgagtggcaggttcaagccggaggcgctgtatttccacacaggaagaaggccaaaaaaggtgacactgccccctcccagtggctccatgctcctcagctatggctgtccgggccgcctcactcaaagccttgccctccgctgctgccaggctccttgcatgcaaggcagcccccacccggcactgcaacatgctcctcggtgacagctacctgatggaaggtggcacagaggacctcacgctgccgacctgcgaggcccatattcctagcgaggggcagtagtgcccagctgggaggaccctggcttttcgatggtccatctctgtcagctcaggcccagagtgcgtggggagggaacagaggcaccttccccagcgggtgtgttcaactgggcggagctgcgacaaaggaagaggct

SEQ ID NO: 693 - DNA, 426 bp, Homo sapiens
cctcagggctgacagtttgctccccaggcaccaccactcccgcctcccaccttaaccttgcatgagtttaccttgagatgagattgacagctccctcagcagttcgaggagggaagaattccagggagaaccacttgtcaccagattccaatcgccgcctcatcttctcccggagtctctcatgccgctcggggtccaggcccggggtggaacatctcgaactatctttggagctctcactgccactgctggcactgccctccaagcaggggttgaggctgctgtttcctctggcttcgttcaccatggctgggttcctactgcacagggtggggcagggagcatcagggggcaggcagccacacccccgacacatcaagacacctgagtggcaggttcaagccggaggcgctgtatttccacaca

SEQ ID NO: 694 - DNA, 388 bp, Homo sapiens
ctaccaagtggcctccgggaaagccagaacccagagtgtaggggagtgctggctccacacctccccgcagcgccatgatgttcttcaggcccagctgcttagctttgtgcagatggcccgtgatctcctccaggcgctgacggcagcaggtcatgtgcaggatggtctccaggccacagtagttcacggcggtgctggcgatcatcatggaggaggtctccttgtctgagccagggtcacctgctgggtgccaggtcacgtctatgtagagggggccacctgctgccatccggtcaaacctgtagggggtttgtttctgaagagaggttccaggagaaataccatccgtcactgccttcccatggggcccgggagttagagaagcatc

SEQ ID NO: 695 - DNA, 380 bp, Homo sapiens
ccaggaggggagtgggtgatacaaaaggagcaaggacatggtgcagttcacctctgcatgtccttcatccagcatggacccatgagtgcccctgatcactgtgtcctgaaccgaacaccgacaggctctctgggcatctcagcctccctagctccatccccgccaccaggatgatccagccactcacctgccacacagatgtcaaagtagtcaccaaactcacttcggatgtgcttcaccaggtccactgcgtagttgaagcctccctcctcctcttcccactggtcacctattgggtctgcagggttggtggaggtcatagtcactgggtctcacccaacctccagagaccctttctgttccctctacctagccccgac

SEQ ID NO: 696 - DNA, 450 bp, Homo sapiens
aacgctgtgcaagttctggacctgagaggagatctgggaagaactcagcgaactcagcactccacccagagcccccagcctgtgcgaggacggtgcggtgagagtggggtggagggagcttatgggctctcctgggcccctcacctggatgggaaagatcccggggacgatggggcaagtgatgcccatgtcggtgcatgccttcacaaagcggaagaatgtgtcagcctcaaagaaaagctgcgtgatgatgaaatcggctcccgcagacaccttctccttcaagtgcttcaggtcagcctcaaagctccctgcttcggggtggcctttggggtaacctgccaatagggatgacagtcaggagaggctggcctccacctgttcaaggcgagggatgaagagaccacagggactgggcagagagagtcctctgctttgggggctctgatc

SEQ ID NO: 697 - DNA, 386 bp, Homo sapiens
ccctcctctggggatctctgggccactgccctcacctggggtcctcagtccacatccccaggcgcttcagcacctctgtggtagccatctcgcggttgagggtgtagaagtggaggcctggcaccaagccactggccagaagctcctggcacaggctcacggccagctcgatgccatagttgcggatggcagcatcgttgtctttgattggctcaatcacgtccttgatctcctgtggcacctccagcttggacagcttcacaagctgccgaagggagtggtagccctgtccaagacatgaggggctgtggcggctgctggccagcccgtctcccaccctaaatacttctcccccttccatcatccatgccaaccacagtgtcagg

SEQ ID NO: 698 - DNA, 384 bp, Homo sapiens
tgactcctcccaggtcaaccacaagcatgcaaacttcttctgccctcccgctcccaagaacaaagatgtatttgcaaggaaggtctgcaggccctcaccagcggccgttagggaactcgtcccactcctgggtacggtagatgtaactctttggtctggaggcccagaagatgggacgtacatcttcctctcggcgcttggggtgggcgctgagagcccagggtaggggacgcctgggtgaggatggggacagagaattgagacaagggattggctagagggagccggaagcaggggagcacccctgaggctgagttcttccatctgatgccctctgagactggagccttcgatgtgcccagctagccatggcacagacatcca

SEQ ID NO: 699 - DNA, 425 bp, Homo sapiens
ggcacaggatggggaagtcacagccccgcagcctggcctgcagctggggtcaggccaggggcaggggatgaaccagggtccccactccagcatcactcactttgtgaccattccggtttggttctcccgagaggtaaagaacgaagacttcaaagacactttcttcactggtcagctcctccccccacatcttcagcagctcctccttgggggacttgctcttcaggtagaagaggtagtagtccttcagctccccaaaggcaggggaagaggaattgcccctggcagaggggtgcccagaggtcagggcacactcctgacagagggcagtgccaccacatgcccaggaggccattcctgtaaattctgcccctgactcctcccaggtcaaccacaagcatgcaaacttcttctgccctcccgct

SEQ ID NO: 700 - DNA, 438 bp, Homo sapiens
tgcccagccaggtctatctgacttaaagcatgagctcccatccgctccaatccatgctcattcaaaatttaagagcccaggagaggcaggctgctctgccctaagctctggggaacccacgggtgccggtcaagagaggggggcaccccgtgcctccctaccacaccttctggaagacatagcccccgctggggccccagcccacgatggggtcggaggacggcttcccgttgatgttgggctgtgagttgatggtgaggatgccctggcggttcacccgcagcagctcctccttcagcaggctggtctcagccgccaggggctcatcgttccagggcaggcaagtcacctgggagagacggtgagctggctggggcgaccatcaggtttggcaccctgagtccctctcacggcccccaacaaagacccagcctgtct

SEQ ID NO: 701 - DNA, 409 bp, Homo sapiens
gggcctggtactctgtgggaaccctggggcctggcctaccttcacattgacaaggtggtaattaacccggagctcgtacttcttcagcacttgcagaagtgcttccgctgtctcgcgggaagtgaaaaactctaagtaggcctgtgggagagacaggtgcctgtcaccaaccccagccctgccagacgccctttcgcagacacctaaggtatcaggactactggcagccatgtgggcggaataatgaactgtggcgttggcacgtccataagcaaagggtgaggggagtggggacgtgagtttctcagtctggacaggtctgagggctatcagccacccctctcccaatcagtcagggaagactccacgaagaagccatttctgaacagcagcaactggtttgacaggc

SEQ ID NO: 702 - DNA, 354 bp, Homo sapiens
aggcagcgtctttcagctgtaggattatctgaatggcaaaaatctttagtgctgcaggggacctcagtgagatggctttgatggtagttgaataaaagtgctttgaatgaggagatttattatccacttggttttagatatattgtctccatatataacttatatgcataaatatgaatgagagatgatgcttttaatatgttttttctgtttttctagcattggattaaattgtgctttgggtgcagctgaaatgagaccttttattgaaataattggaaaatgtacaacagcctatgtcctctgttatcccaatgcaggtgtgtgtttcaagggggtcacacatggggagat

SEQ ID NO: 703 - DNA, 399 bp, Homo sapiens
gggggtgtggtatctctttgtttactgtgtgaatattatgtgtttgtttttgcaagtagtcaccatttaatataaatataaaattatatagttattaacataaagtctttaaaaatacagtgtatatttttaaggcaatttgcaataatggttgaattatcctttctcaggtcttcccaacacctttggtgactatgatgaaacgccttctatgatggccaagcacctaaaggtcaggggtccccctttcactggctttttaagagagacagaaagattgaattttagatttagagtatttagaaggagaattttccctgaagaaatcccaatgtacatataacaaagaaaagtttagctatcccaaattaaggtactagaggcacaggggagggctaa

SEQ ID NO: 704 - DNA, 351 bp, Homo sapiens
tctcactgcattttaaatggtataaaggatttcacagcatctgaactattctttgcttttatcctatgtctagggcatgtgatatctttgtatctagagttaagtatgtttgactctctttttagtatagtcttagttattcaggaagtatagacggcttttatgttgaattggtggtaatgagtttagaattcaagtgaacttgctgaaactttgtctcttcctaaatgcaggattttgctatggatggcttggtcaatatagttggaggatgctgtgggtcaacaccagatcatatcaggtaataatcacctatagacaatatatctaaaaccaagtggataatcaggt

SEQ ID NO: 705 - DNA, 433 bp, Homo sapiens
aggcatgattgttgctgcacacttggaagtaggtatataattatatgtatagttatgttaaatagacttaattttatagttaaaattagttttgaaattagtttcattaaatatattttattctgaattaatggatacaatgtttcctctttcaactcagggaaattgctgaagctgtgaaaaattgtaagcctagagttccacctgccactgcttttgaaggacatatgttactgtctggtgagtcataaagacctggtattcctgattgcagaaaccatttgtggagtgtgagtattctaagtggtagtgatgtttgtgctaggcagcttgcttattaggtcgaagaagaatccatatattcttggcgcttaaatgaattctagtgaagaaccctttgtttttccagggctggggcaagatgacgtcaact

SEQ ID NO: 706 - DNA, 407 bp, Homo sapiens
ctgctcagatgggctatggtgcaggaacttctctttcttattgaatacatttgtgtctgtctgtctcatgtcatccatatgcatttgcagaaatttttcaaaatgcttctccttttaaggtctagagcccttcaggattggaccgtacaccaactttgttaacattggagagcgctgtaatgttgcaggatcaaggaagtttgctaaactcatcatggcaggaaactatgaagtgagcatcttaataagacccctgaggcatctgcccatgtctttggctagacagcatgtaaatgaaacagctctctgcctttgatagtgttattagcagagctgctagaaagtgtgagaagatggtaatgtgtgtttgcagcagactgggctggtgggaggacgaggctttgaaa

SEQ ID NO: 707 - DNA, 436 bp, Homo sapiens
aggattgctgggaagggtaaggaattacctcattagccttttctcctagtaactgtctcctaatgctgcttcctctctcattcttccttcaggaagccttgtgtgttgccaaagtgcaggtggaaatgggagcccaggtgttggatgtcaacatggatgatggcatgctagatggtccaagtgcaatgaccagattttgcaacttaattgcttccgagccagacatcgcaaaggttatacaaagtttatgtttatcagggggatttacttgtctcactttgacactcatttaaccgtgccagttgtcccattaatctgtgaactcaagaactggttttctgtttctcaacatcgaaaacagggtagtttctgattgtcagctttctcagatactgataacctttccagataaagcagatcttggagacagctgtgg

SEQ ID NO: 708 - DNA, 450 bp, Homo sapiens
gttgtaaatccctggcccatgcatggagtatcttgtaagactgaaattactccaagtattttgggcttaaagaacaagtatattaaaattctatctctgacatactactattttttgtttattgttttgctaaagaagaaatagggaatactttggagcctttgaaaagtaatttatagtgacctgtggcctctgtgtgattttcttgcctttctgatctcaggtacctttgtgcatcgactcctccaattttgctgtgattgaagctgggttaaagtgctgccaagggaagtgcattgtcaatagcattagtctgaaggaaggagaggacgacttcttggagaaggccaggaagattaaaaagtatggagctgctatggtggtcatggcttttgatgaagaaggacaggtgagtggtttcttttggcctaatccattgtgtttcccagg

SEQ ID NO: 709 - DNA, 422 bp, Homo sapiens
agtgatcggaagctgcttggcatttagatttctgtgaaatccaagcattgacacttgagtgttttcagtgagtgaaatgtgctctaatgtataacacttaatattttaatattaatattttattaaaataaaataacaggtatttaatattaatattttaatagataatttttctatttcaaactacatcttttgctcttttccctaggcaacagaaacagacacaaaaatcagagtgtgcacccgggcctaccatctgcttgtgaaaaaactgggctttaatccaaatgacattatttttgaccctaatatcctaaccattgggactggaatggaggaacacaacttgtatgccattaattttatccatgcaacaaaagtcattaaagtaagtgtaggcatgttctctcccaagtcatggc

SEQ ID NO: 710 - DNA, 410 bp, Homo sapiens
acgcgcgtgttctccttagggagattggagtctagtaggaaaaactacttacgaagcagcgcctttgtaatactgtaatacggcaagctttggtctatgtctagtaacaagaagctctgaattactttgaacttcggatgctttttgtttttttttctttccactcctatataaagcttaagagatgtgattgctgtttttggcaaaaaaggggaatcttttcatattttaaaatttttgccaggaaacattacctggagccagaataagtggaggtctttccaacttgtccttctccttccgaggaatggaagccattcgagaagcaatgcatggggttttcctttaccatgcaatcaaggtatggtagaagaactcttagccctgcggaaaccagtttttagttgggg

SEQ ID NO: 711 - DNA, 387 bp, Homo sapiens
aaggtatcactgtaaattctcatttttatttgtattgcccttagtctggcatggacatggggatagtgaatgctggaaacctccctgtgtatgatgatatccataaggaacttctgcagctctgtgaagatctcatctggaataaagaccctgaggccactgagaagctcttacgttatgcccaggtagagagacaagtgttctaatagatggatttttcctatctttgaatgtattactcacctacagttagtagaccttcatggtggaatagaagcaaatatcgaatcatatatttggatcactgaagatttctacagagagttgcagagatggtggtgtagctagggcaaggaagggtaaacagaccatgcctagggtgcttcc

SEQ ID NO: 712 - DNA, 405 bp, Homo sapiens
cccacgccgaggatagattgagcgcagaactaaccgcgctctgaaaggttctaaatgtctgcggggctcagagccggatgtcacgtcgtcctcctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgcc

SEQ ID NO: 713 - DNA, 449 bp, Homo sapiens
cctctgccggttttctcttgggtccttttccgtgccgtcccgcgactccgcctctggccgcgcgtgtctggctgctaggccgacaccaaggactggccgggtacccgggaagaaagcacgtgctccagcagttgccgcgcccagccccgagagaggccctagggcgctgcgggctttcggggtccgcagtccccccgcgacgcgagccaacgggaggcgtcaaaagacccgggccttgtgtggcaggctcgcctggcgctggctggcgtggcccttggccgtcgtcacctgtggagagcacgtcttctctgccgcgccctctgcgcaaggaggagactcgacaacatgtcacccgcgctccaagacctgtcgcaacccggtaacgctgcgaccccgtctgcgtggttgggttgtgtttcttaactcgtgctgtggcctcctaatccctg

SEQ ID NO: 714 - DNA, 448 bp, Homo sapiens
acctttttgggcagcgttttcctatatagagttatgagtgcatcttttataaactccatttactccttattggagattattataaatttctctaaagctcctccctcacacatctttttcacctttcattctttgaagtcaaactttcactttctttaaagaaggtctgaagaaaaccctgcgggatgagatcaatgccattctgcagaagaggattatggtgctggatggagggatggggaccatgatccagcgggagaagctaaacgaagaacacttccgaggtcaggaatttaaagatcatgccaggccgctgaaaggcaacaatgacattttaagtataactcagcctgatgtcatttaccaaatccataaggtaaagtattcccaggttcccatgtgtattcattctgttattctgcaagctgtttcatgtatcagggcaggc

SEQ ID NO: 715 - DNA, 356 bp, Homo sapiens
tctcatttttccctctccttccctcaaacattcattgagatcttattttatgctggacagtctactaggggctggaaaagtaaaagaagaataagacacaggtttttttgtttgtttgtttgttttgccatcaaacagtttggttagtgatgagttgtatccatttcttggtttcaatttcaattcagactcaaggcacaggagggaagaaagtcattcagactgatgagtggagaaatggccctgtcgaagaacgccttgagtatgcccttgtgaaggtaagttacaggggcctgaactggagggctggaggctcatcatggctgactgatcctgttgtgggcggtgtgacagta

SEQ ID NO: 716 - DNA, 428 bp, Homo sapiens
tggctctgtggaggtaaggcagttttttaggtgattttttttttctttctttctttttcttttttttttttttttgtcttttttagggcattgaaaaacatattattgaggatactgaggaagccaggttaaaccaaaaaaaatatccccgacctctcaatataattgaaggacccctgatgaatggaatgaaaattgttggtgatctttttggagctggaaaaatgtttctacctcaggttagcaaaatatggggagaaattttcacagttgcatcttttctttgtcatttaataaatggcgatttgggatatatttctcaggttttaatttggacaagagttcaatggtattggctagtcattccttctctaaatatgtttaggagtcatgtctgcaagaatccgtcttcagagtggtgtggatgt

SEQ ID NO: 717 - DNA, 438 bp, Homo sapiens
agagggcctcctagacagaggaaaaaaaaacaagccaaagttcagaagacagaaattgcaacatttgatttccagccttgttttccttctgctgtaccttattattcactggctttccctctggggagcttatcctttgttctgcctactgtcaaaagactccagtgtagctgtcctgaagtcaaagcatgcattcctaatgtgtgcccaaatttcacaagtggccatcagcagttgttcctgtggtttgggaaagatacctgatctatgctttttttctcaggttataaagtcagcccgggttatgaagaaggctgttggccaccttatccctttcatggaaaaagaaagagaagaaaccagagtgcttaacggcacagtagaagaagaggcaagtcattttgttcaggcctatgggcctttagtgggttgacctgg

SEQ ID NO: 718 - DNA, 350 bp, Homo sapiens
tgtttgggcttcggtttccaggtctgtctttgaggtgctcttggttgtattgaattgctttctgtgctggcccctgcctggctctggagaactaggtgttccaccctaaacaaccctgccttgctgagctgcttggcttcctttccaggacccttaccagggcaccatcgtgctggccactgttaaaggcgacgtgcacgacataggcaagaacatagttggagtagtccttggctgcaataatttccggtaagttaggacctcacctctttcaaccccttttccatttaaaaatgaaagccttttaacagaataattcttcaatgggtgggaagagtagggcatggcag

SEQ ID NO: 719 - DNA, 417 bp, Homo sapiens
agtgagcatttcaacttgattctcgtttacattagagcagtatttaatggttgaaataaaaatgttcatttcagttttgtctctaatgggctttcattaattttctcatgtctcatttctgtgcctcagagttattgatttaggagtcatgactccatgtgataagatactgaaagctgctcttgaccacaaagcaggtactgtgcaactatactttgggcatttctctaaatgtcatatccccaggtgtctgtcatttccctagttgtctgtcagtgaatagtgatgccccatgagggttctgtgggacatacaatcaagtgccagctcctgcaccaggttgctttcattgccatttctaatggggttgagagacgagaatgagtaactatggaaccgagtcctggagatggggaa

SEQ ID NO: 720 - DNA, 352 bp, Homo sapiens
tcttcctcactgtcctttttgtccttttttttttaaaaaaaaaaaaaatagatataattggcctgtcaggactcatcactccttccctggatgaaatgatttttgttgccaaggaaatggagagattagctataaggattccattgttgattggaggagcaaccacttcaaagtaagttatactaatgagctttgtcctcacttcaaattttcttatatgccagtgtttgaaacagtgggaaacctgtgttgttttggattttcccttatgtttagtacattgactttttgttatataaacacaaacattttctggtgttcacttgggtgagagccagaatactttcagagc

SEQ ID NO: 721 - DNA, 398 bp, Homo sapiens
gcacgggctcagtcccttgttaacggagctgaggacaaggtctttctcttctgcagagcctgggctaggtttcccatcttagggtagggaaaaagtcattcatgttttacgagggaaatttgaagttcagtatttgtaggtaagcaccttgaaatgtttctctggaaagcactgtagaaatacattatctctaatggcgctgaacaagagttgtataggaactgtcagtgctgatggatatattttctttctgacccttctttttagaacccacacagcagttaaaatagctccgagatacagtgcacctgtaatccatgtcctggacgcgtccaagagtgtggtggtggtaagtgggtgaccttacattttattccagatgtgttggaaagcttgca

SEQ ID NO: 722 - DNA, 351 bp, Homo sapiens
gccaggcaggaattagcacagttggtgaagggagaagaaatgaagttaaggaagccttcctgaaggaggtgttatcagcattgaccattactacaccagttttatcatcttttgctcatctatggctatcttgcattttcagtgttcccagctgttagatgaaaatctaaaggatgaatactttgaggaaatcatggaagaatatgaagatattagacaggaccattatgagtctctcaaggtaagtggtagaaacagatttttgcttgtttttaatgtgactgttttttatgatcctagtttttaatgtgactttttaaaatggttttgaggagtgtaaaaggctttgga

SEQ ID NO: 723 - DNA, 397 bp, Homo sapiens
tagtacctcaggttcaggccgcagaactaggctcgtatttatatatcagcagttaatggatgcttattaagtctttactatctattgttctggtgccaatgtgaaaccgactgggtagaaaaggaagagctttttagaataaacattctcatgaataagagcatttgctttcttgcaaagcttacatactggccttcttggacatgttttcacagtagttgtagaaaagctaagagtgtctaactaatttttctttgttttttaacaggagaggagatacttacccttaagtcaagccagaaaaagtggtttccaaatggattggctgtctgaacctcacccaggtctgtttggctatggactagagaaagactgggtgtggtaactgacagtgtgc

SEQ ID NO: 724 - DNA, 350 bp, Homo sapiens
cggagtgtgggagttggcagagcagtgaggagctggcagggaggcctccatcaggcagggtgccagcgtcagcattgacaaccatacttctctcctgtagtgaagcccacgtttattgggacccaggtctttgaagactatgacctgcagaagctggtggactacattgactggaagcctttctttgatgtctggcagctccggggcaagtacccgaatcgaggctttcccaagatatttaacgacaaaacagtaggttagtgcagtaagtccttcctttctgcctctgatattcaagctgtgggattgtgactttgaagaccggaatcggtgaggagcagtggatttgg

SEQ ID NO: 725 - DNA, 354 bp, Homo sapiens
agggcatgtttattctgggggcacaagaaactctaaagctcataattgacattataatctcttgttgcaggaatacttgctggctggggcagatatcattgaaacaaatacttttagcagcactagtattgcccaagctgactatggccttgaacacttggtaagaattccattgttccatgtgtctaagatgcttacgagcgtttgctgcattggtagttgctagtgagtaaagcactggaagctgcagagtcaagctaatgcctagttatctgttgtttatgatgagacagggaaaatggtgtgaatccttccagcttgtgaacacagtggcccattcattttccaactggc

SEQ ID NO: 726 - DNA, 398 bp, Homo sapiens
gggaaggtgactgaggaggggtaatggcttttaaaagaagcattgtttgatggttatttttggcatctttaagtgaattctaattctgtttttctaataggtggagaggccaggaaggtctacgatgatgcccacaatatgctgaacacactgattagtcaaaagaaactccgggcccggggtgtggttgggttctggccagcacagagtatccaagacgacattcacctgtacgcagaggctgctgtgccccaggctgcagagcccatagccaccttctatgggttaaggcaacaggtatggaaggtgtactgacagccagcacaccgctttcgcttgtgagtttaagcactacacaaaagagctttgcataaatgagggtctgcttcacctcctcc

SEQ ID NO: 727 - DNA, 450 bp, Homo sapiens
cttgctaacggcgcccccgcacactcctacactccttggttttaaggctgagaaggactctgccagcacggagccatactactgcctctcagacttcatcgctcccttgcattctggcatccgtgactacctgggcctgtttgccgttgcctgctttggggtagaagagctgagcaaggcctatgaggatgatggtgacgactacagcagcatcatggtcaaggcgctgggggaccggctggcagaggtaaggcagaggcattgcgccgaggggctgaggacagaggccaggcagtagggagcctggggtgggtgcctgaagactgatcagcccttagaaccagtgtctttttttttttttttcttgagatggatgctgctggctttaacattatacgtattttaatattatgtatccccagattgcttgtgtacattatctttgaggca

SEQ ID NO: 728 - DNA, 450 bp, Homo sapiens
atggtccttcagagctcaggttgaggccaaaattgagctgcagagcagcagctgatgaaagtacaaaccaatcaagaatccagcctgtttcctcttgtcaaatttcccctggctgtggtccagatgagggagggtgtcctcatggttctaattcagggggtggaggctgcactgatgctgtgagcccctgcgtctgcctaagcatgcctgctgctttgggtcccaaggcctttgcagaagagctccatgaaagagttcgccgagaactgtgggcctactgtggcagtgagcagctggacgtcgcagacctgcgcaggctgcggtacaagggcatccgcccggctcctggctaccccagccagcccgaccacaccgagaagctcaccatgtggagactcgcagacatcgagcagtctacaggtaggagccaggaggctgcgggttcctgtc

SEQ ID NO: 729 - DNA, 423 bp, Homo sapiens
aggcatgagctcgctttggttcacttgttcaacaagagttcattgagtgcctgctagctgcaggccctgtgctagacactgagtccataagcattttccctgtgttgctccctctaggcattaggttaacagaatcattagcaatggcacctgcttcagcagtctcaggcctctacttctccaatttgaagtccaaatattttgctgtggggaagatttccaaggatcaggtaagctagctgttgcattatatgtggcttgcctagttcaaatgaaattctagaacctctctcattttaaatgtgaatgagaataaagtgaggggaaaggatgaagaaatttactccagttaatgtcttaatttgatttcaatagaatacctctattctagccctcacttctacatgcaagccacacacacgc

SEQ ID NO: 730 - DNA, 448 bp, Homo sapiens
tggcaaatcttgtggaaacttctattccaaaagtcttatcatgttggtttaataaaatgcttctcatcttttgcaggttgaggattatgcattgaggaagaacatatctgtggctgaggttgagaaatggcttggacccattttgggatatgatacagactaactttttttttttttttgccttttttattcttgatgatcctcaaggaaatacaacctagggtgccttaaaaataacaacaacaaaaaacctgtgtgcatctggctgacacttacctgcttctggttttcgaagactatttagtggaaccttgtagaggagcagggtcttcctgcagtgcctggaaaacaggcgctgtttttttgggaccttgcgtgaagagcagtgagcagggttcctgtggtttccctggtccctctgagatggggacagactgaagacagaggt

SEQ ID NO: 731 - DNA, 383 bp, Homo sapiens
tgcggaggaaaagaaggacaagctaacgtttgtggttgatacgttaggcctaccggatgaacatgtgctctgcaggagtggccagaaaagctgccgaggaggtaactctccagacaggtagggaatgttcttctctttttttgcacacgtggttcctttgatactgtcagctataatgtgctgtccttattgcagtttttccttatgtggcctttggcttacgagtaacactgcagagactgtattttacatgtttgtagattacttctctgcagtttcataatcaagcactcaacatctttgaattgatgccaactctgtggtccttgggctcggaatttgctctttcaccctgggttagcctgactttgtagctaggcccc

SEQ ID NO: 732 - DNA, 382 bp, Homo sapiens
tcagccacttagagatctcacacttgtttttcttttcccaaaggaattaagaggtttgtggcaggggctctgggtccgactaataagacactctctgtgtccccatctgtggaaaggccggattataggaacatcagtgagtatttaccacatataatcattgatcttggggaagtactccccaagcttcagtaagctataaatctgtaaaatggaatcaataacaggatctaccttagagttactgtgatttaatccatgtaaaacgtgtacagcagtgcctggaatatagtagacatctaaatagaaagttagctatgatgattattattatttgaacttgctttcaaatatatatggtggtgtgttaatgctgctttgt

SEQ ID NO: 733 - DNA, 440 bp, Homo sapiens
tctggtagtgcagtgggtggagatgatgagatcaagcaaatatggtttgtaggtttttggtttatggaactttgtgtgctgtgataccacactttttcactaggagttgttcataccaggcttatgtgttgttgatgctctctttggtctagacctgccagtggggagctaacttacccttgctcttgggctgtacaaggtgaagtacggtaagtcttcacttaacgtcattggcaggtttttgaaaactgcatctttaagcaaaatgatgcatagcaggccctcaaataatgtcatttccttcaacagaatttcattataatgttgattagaaagaaaatactggttttgttacatattgtctcagtcaaagttgcaatttctgagaacctgtcaacgatgttacaagaggactttgttgtgtaggcttctctgttgga

SEQ ID NO: 734 - DNA, 412 bp, Homo sapiens
acgccttccctctcactcctcagctcatacatgggaagtggaagttacgtggcaggtgtttaggaacagctgccttcagcttacttgtttaccttctgtccctgccacctttctttatttggtttcttacaaaagatcatgttcttaaactatgcattgtaaaccagcaatagttcacaggtgccagacctacactcgagataccctagggccattcagaggatattgatgactgatgtgctgggtgtgatttattttttgcagcatttgatgagcttgttgaagcataccaagagcaggccaaaggacttctggatggcggggttgatatcttactcattgaaactatttttgatactgccaatgccaaggtgagttaagggagaaaaaacagacaaggctggggtaaggg

SEQ ID NO: 735 - DNA, 392 bp, Homo sapiens
ttgagaaaggggtgctggggttgtgccttataaggaagacacttcttcccagagagcttgatgtatatcttatctgaagaggtcttagaaaagggtgcattctaatcaggaagttagactaatcttggacacactctcagaaataaagacgttctttcttttttccctgacaggcagccttgtttgcactccaaaatctttttgaggagaaatatgctccccggcctatctttgtaagttctaaagtgtttgcacaatacattcttttattaataattgtccttttgagcatgtttttcccccgctttgcatagtagaactattaatggtatctttagaactcatctactttaacttccattgttcacttcccttccaccacttctggacca

SEQ ID NO: 736 - DNA, 377 bp, Homo sapiens
tgcctctttccctagtctcttggcacatgtctgttctgactattatagaaagtgccccctttgaatttgagttccacatttcttttccttgtaaaagagcaaaggaagtcagtgtgttcattttattttgcctttatatctatattcttaacttgagtctgtattgttgactttgtttactttgtcaattcagatttcagggacgatcgttgataaaagtgggcggactctttccggacagacaggagagggatttgtcatcagcgtgtctcatggagaaccactctggtgagtgatccatctttctgtaacttcttttcttttttggggaaccttttctgatggctgtggagtgtgacctgggaggggattgcttc

SEQ ID NO: 737 - DNA, 447 bp, Homo sapiens
acacaaagttcaagtgcttaactatgatttaaaactagaacatgatttgagtattctaaataagacatggaatttttttttttttttttttttttaggtaaggttattttcagtagtagtgaattaataattgcttgtttttatttttttctagaacatcttcctaaacttcaacccagaccatattcgtgtgcaaggtactactatttattcacgtaatatatagcattgtttctccaaaatcttagactcaggcttccagatcattagagtttactaatttattcagtgaaaacttacctgctttatggaagacagtaccaggcataataaagcagaagaagaatcatagagctcctgtcctctgggacttcatagaatttaacatcttgggtggcttcccatggcccagtactatgtttccccacttaggagtctcaggctcct

SEQ ID NO: 738 - DNA, 450 bp, Homo sapiens
gagtgtgaaggttgggggcagtttttaattacgtaataatggctttcctctgtgaggatttggaaggtagattagagcctataaggaaatatttctaaactgaataaaaggattggtttgacccatatgtgtagtagtactgatatcgagttcaaaacttgtctgtgtatctttgcagctcaagtttatttcacccaggaaagctccattttgtcttcaacattgtggaatttctgtctactgccacaacagaggttctgcggaagggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatca

SEQ ID NO: 739 - DNA, 399 bp, Homo sapiens
ggagtatgtacaggctggctggccttgttggttgcttcagttcttcagccaaacatacatgcatcccatgaagacagcgggaaagccctggctcctaaggtaagaaattagtaccttaacctcagcattgttaactcatactctttgtttcattagaaaaaacagtgttgtctcacccacatcattcattactgtcataagaaaatttatgctgttcttgaattttaaaatctctattgcaagagcagaaaactgtttacttccatgtactctttaactagtgtgtgtattttctgaatgtataaagcatgaattttatatagtacggtctttgcttgtcctattcatggaaaagaagaccttttatgttgatattcttggtacattggcctggggagg

SEQ ID NO: 740 - DNA, 449 bp, Homo sapiens
actcttgcctaggttttctttcatacttaccacatttgatgtaatatttcagatatccatctctcctcgaacaacaaattctttccacttaccagatgacccctcaatccccatcataatggtgggtccaggaaccggcatagccccgtttattgggttcctacaacataggtatgttctttttttggctaatgggaaaatgtattcctgagtaaccgtttttgtttctttagtcattttgaggataattggactttgtaaaatttttatttaaaaaattattattcaatgtgcgataacataatttgtcaccatgggaaaagtaaacacaatgttgtagagattgtgctttgtactagaacttccttttttactgtggcacttttagttttttcttttctcagctacactggtttgtagcatatgtggttggggacaaatattgggca

SEQ ID NO: 741 - DNA, 448 bp, Homo sapiens
tagctgcctctccacacacttgcctagtgtggcatctgctcgagtggccatgacagcctgtggagagtaaaatgctaattaaatgactgaatgttcaaatgcagagatggattttacaaatccgtctgagtttgttggtggtagttcctaatgaaagagattggttttacatattctttatatcacacacctaaactttttttttttccacttagagagaaactccaagaacaacacccagatggaaattttggagcaatgtggttgttttttggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatggga

SEQ ID NO: 742 - DNA, 374 bp, Homo sapiens
tggctgcaggcataaggatagggattatctattcaggtattgtacaattccagtattgtactcaaccactgagtgtacaattctaattctcagactttttcagcttgacaaccttttagtgatccattatatattatatttcagaaaagagctcagacatttccttaagcatgggatcttaactcatctaaaggtttccttctcaagagatgctcctgttggggaggaggaagccccagcaaagtatgtgcaagacaacatccagcttcatggccagcaggtggcgagaatcctcctccaggagaacggccatatttatgtgtgtgggtgagtcattatcgtgcctaagtcgggtaggagagggccatcagtga

SEQ ID NO: 743 - DNA, 432 bp, Homo sapiens
tgcctgtttgtaagcagtcatcttattattttcttttctagagatgcaaagaatatggccaaggatgtacatgatgcccttgtgcaaataataagcaaagaggttggagttgaaaaactagaagcaatgaaaaccctggccactttaaaagaagaaaaacgctaccttcaggatatttggtcataaaaccagaaattaaagaaagaggattaagcttttttgactgaaagtactaaaagtcagctttactagtgccaaacctttaaattttcaaaagaaaattttctttcaacatttcttgaaggacatggagtggagattggatcatttaacaatataacaaaacttcctgatttgattttacgtatcttctatctacgcccttcctgtgcctgtgactctccccaaattgccctgttgccttgagctctt

SEQ ID NO: 744 - DNA, 367 bp, Homo sapiens
gagaaagccggccaggtctttgacacccagccggaccaactgcgcggagaccccgcgttgacacctaccgcgctctgccgggcaatcactccgggtggtcgcggaagcgcctgggcgtcgtgggcctccgtagcaaacgcggggcgggagcacgactcagggcggcgcaatgtgattggcccaggtccccttcggagctttctattggtcctgggtaccgagcatgggcgctgcgtcagtgcgcgctggcgcaaggttggtggaagtcgcgttgtgcaggttcgtgcccggctggcgcggcgtgggtaagctgcctgtcggctacggttcccggattccggccgctcgccctgcactaatctcctgg

SEQ ID NO: 745 - DNA, 445 bp, Homo sapiens
aagcccaagtagtttcgagccgatcatctgatttctgagccatggaattagagtttcattcgtacactctccttaatttgatgaattcttatttaggctcatttgagattagtgctgaaaacaaatttagaaaaggccatttcatattatgtgtgggtattgttgcattgtttcttaaagattgagggagaattaatatctttaggttgttactgcttcattaaaaagaggatcttttttcccccatttttcagtttcactgttacatgccttgaagtgatgaggaggtttctgttactatatgctacacagcagggacaggcaaaggccatcgcagaagaaatatgtgagcaagctgtggtacatggattttctgcagatcttcactgtattagtgaatccgataaggttagagccgttacagtggattttaccgttttgtgct

SEQ ID NO: 746 - DNA, 440 bp, Homo sapiens
gctgattgctttgctgctgagttaaatcaaaaatgcatgtagtgttaggtccctgacttgatatccttgttttgtagtatgacctaaaaaccgaaacagctcctcttgttgttgtggtttctaccacgggcaccggagacccacccgacacagcccgcaagtttgttaaggaaatacagaaccaaacactgccggttgatttctttgctcacctgcggtatgggttactgggtaatggactctctcttctgatcttactatagtatactattgatatctctggtatctgaattatctttcagaactatgaagtgtgatcatataggttttgtctttcttatgtaaatattatgtatatgtatatataaatgtatgtaatgtgctaccttttctgaatcttccccagactttaccccagagccacacctctgcagaacctc

SEQ ID NO: 747 - DNA, 406 bp, Homo sapiens
tgtgaagctctgcattattactccatccataagagcatgaaatagtattattttagatattttatttacctagtctttgtgtccttaaatttaaactttattgtgcattaattatgtatttgggttctctaggtctcggtgattcagaatacacctacttttgcaatggggggaagataattgataaacgacttcaagagcttggagcccggcatttctatgacactggacatgcagatgactgtgtagggtaagggcagtgttctctgtttactccaataagccctctatacatgatggaagttgatttgtaaaacatgtcagcttttcacttaacactgaaattttcctcatgttttacttttgttcgcttttttagctttaggatccaagagggtcagccaga

SEQ ID NO: 748 - DNA, 450 bp, Homo sapiens
ggcatttgttttgtttttcgtttgtttttactgtccagtttagaacttgtggttgagccgtggattgctggactctggccagccctcagaaagcattttaggtcaagcagaggacaagaggagataagtggcgcactcccggtggcatcacctgcatcctcgaggacagaccttgtgaagtcagagctgctacacattgaatctcaagtcgagcttctgagattcgatgattcaggaagaaaggattctgaggttttgaagcaaaatgcagtgaacagcaaccaatccaatgttgtaattgaagactttgagtcctcacttacccgttcggtacccccactctcacaagcctctctgaatattcctggtttacccccagaatatttacaggtacatctgcaggagtctcttggccaggtaaggaagtttttctttatgctatagatgcta

SEQ ID NO: 749 - DNA, 355 bp, Homo sapiens
gtaagcccctgtggatcttgcgtagtcactaattgaaagaagggtataattgaaaattgcacttacgttttgtcacatttgtttttcaaggaggaaagccaagtatctgtgacttcagcagatccagtttttcaagtgccaatttcaaaggcagttcaacttactacgaatgatgccataaaaaccactctgctggtagaattggacatttcagtaagttgcaaaatttatttctcagcacagtaatattgtcaggatgtgcagaaagagttgtgtggtgcttggttatatatgctgagtggtgtgctgcttggttacatatgctgagttgtgtgcggcttggttacatgtgctg

SEQ ID NO: 750 - DNA, 430 bp, Homo sapiens
aggcaaaacactgggtaactaccagatttcgttttaatagtaactgctaataatgaaagtatgtttatttggttagttgggcttattttttaaaacaattgtgtgtttttttttttgaaattctattttctgagttcacatattaaaatcataatattgaaaactatatttttgttaccctacagcttaaactatgtaacacgtataatgtattttttttttttcattttggctcttctctagaatacagacttttcctatcagcctggagatgccttcagcgtgatctgccctaacagtgattctgaggtacaaagcctactccaaagactgcagcttgaagataaaagagagcactgcgtccttttgaaaataaaggcagacacaaagaagaaaggtaacagccctgatgctgtgacgttggggtgtt

SEQ ID NO: 751 - DNA, 368 bp, Homo sapiens
tcatgttgcactttgatgcgctgtaaagtactacagtaattgtgttttggggagtgtgtaaaacattttattcttcatcttctatgtcatgaacccctttcccgtctttacctgaaaaggagctaccttaccccagcatatacctgcgggatgttctctccagttcatttttacctggtgtcttgaaatccgagcaattcctaaaaaggtatttttttctgtcttcttcaggtaactattttaaaatatgcttagctttatttaggattgattaaacaaatttagaatatgccctttgcagtcttaaaaaatgtgatcttgatagcatgtttttaatattagttcccaagggtgtgtgctatcatcgt

SEQ ID NO: 752 - DNA, 394 bp, Homo sapiens
tccctcctcctgacaatagctcctagtggctttctcattttttcttgggtaattgggtgcatccctaggcagacatttaactgaatattctaatagctctacccacaaattgtgtcacaatttaaggcgggctcctttttgtaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcggtgagtagtcgctttcacaagcaccttggtggctgttcgtgcactggtaggcgggccacctttctgtag

SEQ ID NO: 753 - DNA, 352 bp, Homo sapiens
aaggttggtggaagtcgcgttgtgcaggttcgtgcccggctggcgcggcgtgggtaagctgcctgtcggctacggttcccggattccggccgctcgccctgcactaatctcctgggagaggcggcccggggcgggggtgggcagccggcttgcgcccgtggttcccacgcccttcggcctccgggggtcgccgcgggcgcgggctggggctcggacttggcctttggcctttggctttggtgtccccgggagcgtgtccttgggctcggcgtcggcctctgccgcgggaggcccctgggcggcgtggggtctctcctcatgttctgcctttggttctaggcgctttccaggc

SEQ ID NO: 754 - DNA, 354 bp, Homo sapiens
tgtctgtcatcattttactacattttctaaatgtaagtgactagtaaatacttttgaaattccccccaacagtttttagtacctggaaaagagggcctatgtccacatcaaaaccaagatcagcaaatcctgtagcaataacttttgctcctctgtcatggccatcttgtcccatttttgctacaagaagacgaggtctgcgaccttcacgttccatgaatttatgaaccctgaaaaacatttaaaaatatatcagtagttagatactaattttccaaagggaagatataaaaactaatttattcacagcaaatctttcaagtttatttaaaagcacctaatttgtttacttgt

SEQ ID NO: 755 - DNA, 370 bp, Homo sapiens
tgaatgcaaaacaacactgtccacttttagaccttgtagaatttatttagtgaaatcaccaggaaataatatgttcctaaatctacaagtttatctttagaaccacaaataagctatcattactcaagattcccatcacagtactagaaaaatagagataaaaaatacctgaggtggtatcacccctccacacatgacaagaatatctggccgtccaagggagttaagttctttgatgagttcaggaactagggttttatgaccagcagcgagggtgcttatgcccacagcatgcacatccgcatccacagcctgctgggccacttcacgaggagtctaaacagtcagaaagtaaagataaatcattgtt

SEQ ID NO: 756 - DNA, 445 bp, Homo sapiens
ataccattgtccagagttcttgataaagtattgttatagagagtatagagagtttttagggattttttttttatttttgaagtgaaactgtatgtacatacttatagcatgacaccaggcctataagtaaggtattttaaagtaaagctttcaaggaaagtacaaatcaggtattgaaattaaattgaagacatagctttactctcttctttgatcataactaaaataatattttagacaaaagctaaaacaaaaagaggatattatacagattgctgcttcttttccaaacacttctcaatatcatcaagcacctgaacggcagcctttggaattcgagtcccaggaccaaatacattggaaacaccaacttcaaacagaaattcataatcctgttgaaagaatgtgtttaattaataagagccactatttccattttcacgga

SEQ ID NO: 757 - DNA, 381 bp, Homo sapiens
tggtccacgtgtgaatggcttcactcctggaagttcttcaggtaagtccatagtatctctcttggaatacaagggttttatagagatcccttccggggtgtgccatattaggtcttctgggtttttgcctttcagctgctttttagccagggcagcccattctgggtgaaggggctgttgctggtgtagaagtcgttgctgtatgagcctggagcctgatgattcttttacctgcctcaggtaatgaggtgaaagtaaaaaaagctgattcttagctcttaacatggtggagcatggaaacacccaatagaaataagaactgacctagaaaaagaaacatagagtaaaaacatttagaagagggggtgggaaataggagct

SEQ ID NO: 758 - DNA, 377 bp, Homo sapiens
tcatctttacagagattaacccccaaaaaataaaaaactaggaggcatatgacttatcataaatattatgtcttacattaaaatctcacccttaatgttgtccttatagaacttattgctttcttccacagtactaaaaccagcatactggcggatggtccagggcctaaaggtatacatggtaggatatggtccacgtgtgaatggcttcactcctggaagttcttcaggtaagtccatagtatctctcttggaatacaagggttttatagagatcccttccggggtgtgccatattaggtcttctgggtttttgcctttcagctgctttttagccagggcagcccattctgggtgaaggggctgttgctggtgta

SEQ ID NO: 759 - DNA, 449 bp, Homo sapiens
ggaactatagaaaaacctataataaccacaaagtatacctttgctgtatattcaaatatgtcagcaataattttcatggatggttctggaggaaaaatgtatgtatttcgaaccataaattcctttagtatatcattttggatggtaccagtaagcttctctttaggtacaccttgttcttctccagttactataaaatttgcaagaactggaataactgctccattcatagtcatggaaactgacattttttctaaaggaattccatcaaaaagaattttggtatcttccacagtgtcaatagcaactccagccattccaacatcaccacgaactcgagggttgtctgaatcatagccacgatgtgtcgccagatcaaaggcaactgataatccctgctgaccagctaaatatataaagaaaaataatgtaagattcaagagtctgga

SEQ ID NO: 760 - DNA, 422 bp, Homo sapiens
tggtcctatgcatttcttaatgttgaaacaatatctaggtttaatttactcaccttggtgcaaattcatcaattgtcaggccagcctggagtccagttctagagtactccaatccatctgctaaagtataggccagctccagaatggcatcagcccctgcttcctgcatatggtatccactaattgaaattgaattaaattttggcatgtgctacataaaaaaaaaaattgtaacagtgaataagtaaaaatattaaaaggtcctattaaatccactttctaagcataaacattattttaaaatgatgttaaattcaaataaacttggtagttcataatgttaacaaaatatttaatgcttatttgttacatttaatttgctttccaatttaaatggttcgtccatgaaccatcatcaggac

SEQ ID NO: 761 - DNA, 404 bp, Homo sapiens
cctgcttgtgccacattgctcagaaaaaatatatatatataactttattaaaattctacattttaaattatatacatacctgctcagtaagtgaccatccagatgtctgacagtgtgctcttagaagaagagattttgagtttttaggctgaaacattttctctattaagtgagcccagagtcttctaccagctctcatctttgctatttccatatagaaattcattccaattccccagaagaaagacaacctaaaatagtaacgttaggtccagaatttaattaaagttaacaatatagagcagaaaataaaactaattgtatcacacactagaaaatcaaggtctatattttaatttcgaagaacttaatttgaattaagatcagtgcacgtacatttatgt

SEQ ID NO: 762 - DNA, 371 bp, Homo sapiens
tctgaaaacaaagttgcaaagtggaaaaacttacctttaaagcagcatcataaacatcatttgtgagacattccatcatgtaagaacctccccaaggatcagccactttgggaatcccagattcttcttgaatgatgatttgtgtgttcctggcaattcgagcacttttcacagttggcaaacccaaagcttcatcaaaagaatttgtgtgcaaagactgagtccctccaaatactgctgccattgcttctattgcagtacggacaatattattgtagggatcctaaaatatttgataaaaaacaaaaactcaaagaaacaggtgatagatattgcaactataaacagcaacatgattaaacagcaactgc

SEQ ID NO: 763 - DNA, 437 bp, Homo sapiens
atgcttgcctgtgtgcatccatgtatgtgaaaatacatatatagatagatacaagtatatgagaaaaaatttacccaagttccatttttcattatttttgttttgttaactatacatgttatcttcaaacagaaatgaatttctttttaactactggatttcatatatgaactttctcactatcttaccagaatctattctagcttgtcttcgggcagcacattcttcaattcgaagtttaggtattccctcagctacagctttggccattccacccatttcttcaatttcattaatgagctaaaaagaaaaacattaacaaaactaaaagagaatattaaaaatgtgtgtaaactatataaatttgttatgagtgttatataattactaatattaataaaattataaactaaatgttaatgtttcataagaacaga

SEQ ID NO: 764 - DNA, 450 bp, Homo sapiens
acaacttataagtttcacagaggtagatatcatggtttaaaacaagtttttggtgtcaacagactaagactgagtcctggttgtctatttatcctgagcaagtttctcaatgccttatctttagttcccttacatttgaaatgatggaaattaatacacacctcatgctgttgtaaggattaatttaagcaggacagtttaaaagcttagccagagcccagaacacagaaaatacttaaaaaaaaaaaaaaaagcaagctattaataccttcttaagtttttcaatctgcctgtttcgcactgaagtattatcaattgccagaacttctacagcgtcttctttttccaactggtacttatttactccaacaattacttcagaacctggtaatttcccaaagaaaaattttattcacaaataattacctaattgtaatgctctggttatga

SEQ ID NO: 765 - DNA, 443 bp, Homo sapiens
ggtcaacttttagtctttggaaacctccaaacttatatatcttcaccttgcccgagatgcatccactgcaagagccaggatatttccatctccgctagcagcacattcggttagtgcagcaagacaacgttcagccaaagcttgatccctgctggatttgatctatggaaaaagtcaaggaaagggacaatttacatgaagagagaataaaacagagatcaagagattagaccctgatgcatagcatatggcatttttttccataatcctaactccaaatttaagaggaaaaaattgaaaagaataatatataacctaggaattttattcattcaattcattcattcactcaggatttcctaaaataatattacatttggtataatcctaacaaatcagaaacatgaagggcaataatagtgctgaccttcccaagtagcaca

SEQ ID NO: 766 - DNA, 418 bp, Homo sapiens
agctcccagtagattcaaggggattgtgctaacagaaaagatgaaattctggcctaagaaaccttacatattacctcttgatagcagatgttatctctttactttctccaaattcctggcgatatgctccactcaccattcgatcattcgctttatgttcaccaaatacctttttcagggcatctgtgatttctcccactgtacatctgaaacatgaaatggtggttccattaacttcattattttgtgataaagatatctgtttaccataatattcaatataattaaacattttattacataagtaaatgactgtaaaaatgtaaaataagaattttttaatgcattatgaaagcatctcttctgaaattacttaagaaaaatttattctggatgcctttatgcatccaattctctt

SEQ ID NO: 767 - DNA, 442 bp, Homo sapiens
ctcctcaaacgcacccagaggagactcctggtcccctgtccggaccccgccccgaccaggtccagccccgcccaacggcaagttaagagccccccagtgccagacgctccagacagactgccactcttggggggcaagagttggttgtcgtcatggcgacggcgctgatggctgtggttctgcgggcagctgctgtagccccgaggctgagaggccggggaggcactgggggcgcccgaaggctgagctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttc

SEQ ID NO: 768 - DNA, 425 bp, Homo sapiens
ccgaaggctgagctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtgagcggagcccggcgtgggccgtgacgcagcgaggggatggggttgtgcggccacctgtcctcaggcatggcaggatacg

SEQ ID NO: 769 - DNA, 422 bp, Homo sapiens
tctggaagggtagggtcaccgagacggccctgcaggccaggctgtgggagccagcggctcaggtccgtgtcacgctccttgaaagcccactcctccgcaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccaggtgagtgcccgccctgcccgcccaggcgtcctcagagcgtgctactc

SEQ ID NO: 770 - DNA, 445 bp, Homo sapiens
gctccccatgccaggtgagtgcccgccctgcccgcccaggcgtcctcagagcgtgctactctgcccgccctgccccgtccggcaggcctggagggggccctctcgagcaccacgtctggcccacagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtgcggccctttctttcaccttcccccacgccggcgatccgggccttctcttgcgcccctcgcacttctccccgacgggccgcagactcactagcaagccgggtg

SEQ ID NO: 771 - DNA, 441 bp, Homo sapiens
agaaaagagaggtccgtgggggtaggggggcagtccgtgccggctgtgggccaggctcacccgctgactccggacacaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaagggtgagggcggtgggcgggccggggactgggtcccgggagtgagtactggccggggctgggtgtctgcggtcaggaggagcggcttctcctcctgtccaggagccgtagggggaggcggggggtgtcacagcaatggctcctgctgctgccgaaacccgggggaggtgagagaggaggagac

SEQ ID NO: 772 - DNA, 434 bp, Homo sapiens
acaatctctgcctggggaaagcatctccttgaatgaaaatcacagacaaatctatgcagaccactgaaatcatttcactgtggaggtctcccaaagacggaaattgtcccaccagcgcctgtcctacctgcagtccccaccaggctgcgcaaacggccctccagccagactagcccctccccatcctcctccagggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgaggggtaagcctgcggaccccagagggcggggtctggggggcagtcgggcagcttcggaccaaggagaggtc

SEQ ID NO: 773 - DNA, 424 bp, Homo sapiens
tctacgtctccgaggggtaagcctgcggaccccagagggcggggtctggggggcagtcgggcagcttcggaccaaggagaggtcccagcctgccgctctcccgctgcgccaggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtaggtcctgccactcccagctctgggctgggccctgacttccctcccctctcccacccttgccaaccatgccaagaaggctgggcttcctcttcttccactggtctccctttcactacctcccagggg

SEQ ID NO: 774 - DNA, 381 bp, Homo sapiens
ggccttgccctaaaaactgtttcctacatcacctccccacacccaggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctgaccctcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacagga

SEQ ID NO: 775 - DNA, 353 bp, Homo sapiens
cccctaagcaaccacctgacaggggttggagaaaggaaaaaggttggagggaattcgggtcagactcacgttgagccggcgggaggcagatataggtcttgaagaactcgcttcggcgggcggcctccttaatacggttggcaagcggcttgctgacctgccggatgcccaagtatagcagcttcgccatagggaacgcgcccaccaccatcttggcggtctcacagggcacgcgcaaccttgctgactgggcggggcgcctcaacctcttcactcctcccccgccctctcgtggccatgcgtgcgtcagtacgtatgtacgtacgctcgagggaaacttcagaggcgcatcc

SEQ ID NO: 776 - DNA, 448 bp, Homo sapiens
caggttccatccagcaagctcctatttcttggacgcaggcactgcgtgggaagcggaccggccgggattgcagagctgggcgcgcacctcttgcagctctgtgcgcagttcctccagggcgccctgtggcggcgccgcctgcacctgcgcctgcagcgcttccagcgccagcgccaggtggcccacctcgtcccgcagcgcgttccaggcagcacgctgctcctcctccttgtggcgctgctgcgcctggtggcgccagtactccagcactaggcagccgccgcccacgatgaagatggtggcttcgcccagcagctctgcgcccagctcagctgccgcctcctcgttcagcggcttgatgaccgtgccccggaagcccatgatgcgcatcttggtccgcatctccacccagtgatacactgcgggggaagagaggggtcaggctgcg

SEQ ID NO: 777 - DNA, 444 bp, Homo sapiens
acagatgagtgtcccagtaaaggttaacactgatcaggtaaaccgggggtgggggtaacaataacacattgattcagctcaagaccaggttccattttttcatttgccagagtgcccacggtgtcctgctggctgggaccttgcaggtcgtcctggtttggagtgggggataggaggtgaaggatgatggagggggctatgttgcaacgcttcacctgctggtcccagtggcaggtaacggctgctcttatcagcaggggtaaccaaatgccaagttgcatcaagatcctggtggtttccactgggccagcgcaggcaagggtggtgcgggaagaaggccacgttaggtacataggccatgtccaaattcaggttccatccagcaagctcctatttcttggacgcaggcactgcgtgggaagcggaccggccgggattgcagag

SEQ ID NO: 778 - DNA, 446 bp, Homo sapiens
agacctcctatttctcggacgccggcgcaactgggggtgcaggcggcgggtctcggaggcagaggtgggctcgcacctcctgcagctgagcgcgcagctcctccagggcgagctgcgtcgacgtcgcctgcacctgcgcctgcaactcctcgagcgccagccccaagtggcccacctcgccccgcagcgcctccctggcaacacgtcgctccttttccttgcggcgctgctgcaactggtggcgccaatactccagcatcaggcagctgcaggcggtgatgaagatgatgccctcgcccagcagctccgcgcccagctcggcggctgcaccctcgttcagcggcttgatggcagcggcattgaaacccatgatgcgcattttggtccgcatctccagccagtggtacactgcaggaaaagacaggagtcaggggtcttttgcaggg

SEQ ID NO: 779 - DNA, 427 bp, Homo sapiens
cggtagggaggtggggtctgataaaagacgctgtctttccaaagtgctcaacaaatgcgctggcaggggcggggtgggatagggcggggtccttcttggaacgttccacctgcaggaggcggagagtcccagtggaaggtaccactgggcaggttagtagggaggttcgatcagctccagcccaggatctctccggcgcccccgaaggactgggtggtgtcagctgggccggtccaggatgggacagtgcggagaataggccaagacagagacttcgcagtccagacagcagtcacctccaagaccagggccccgagacctcctatttctcggacgccggcgcaactgggggtgcaggcggcgggtctcggaggcagaggtgggctcgcacctcctgcagctgagcgcgcagctcctccagggcgag

SEQ ID NO: 780 - DNA, 356 bp, Homo sapiens
tgtaaccctgcaaagctgaaacctaattcaccttctctaggtccctaagcagactgtcgctaatgtttatccatttctttctttctttgttgtgtcatcaggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgct

SEQ ID NO: 781 - DNA, 393 bp, Homo sapiens
agcggtggagcttggcataaagttcaaatgctcctacaccctgccctgcagtatctctaaccaggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtaagtgatggtcagagacttgggtttgatttaggaatcatggtgatgcataaaactatattctgcagtaaggcctctttctgcagaatgtagtgccacgct

SEQ ID NO: 782 - DNA, 360 bp, Homo sapiens
acatgggtcttttctgaaatacatatttctcccttttaaatctctttttacaggtgtggacaaccactacaaaataaagtgcagctgaagggccgtgaccttctcactctaaaaaactttaccggagaagaaattaaatatatgctatggctatcagcagatctgaaatttaggataaaacagaaaggagaggtatgtaacattttctttttacgttccattactaccagtcccctttttttaaaggcagccttcccaaagaaagagggaaaaaaatacattaaaattcttaaacagtagctaagtaatgaaacctcacagtcaaggtaattgattatcatggagcatacaggcatacaa

SEQ ID NO: 783 - DNA, 350 bp, Homo sapiens
tttaaacacttatttgggggtagttattacttattttctaataaagaatatgttttaaaacataatttatatataagatatattttaattctattcttgtccttgatttatagtatttgcctttattgcaagggaagtccttaggcatgatttttgagaaaagaagtactcgaacaagattgtctacagaaacaggtaagtccactgccaaattcacacttgtgttgaagagagggattgaaggtgaagactttggaggggtaacccagtgcggggatttgtctgcctctagcaaccacaaagaaaaaatcatttttactgggagcagcaatgcaagcctgtgaatgaga

SEQ ID NO: 784 - DNA, 422 bp, Homo sapiens
tcctcattttgctttgcatgggaattctgtatcagagaagttggagagctttaaagattttgacttttcagttgagatgatgccaattctttgtaattttgttttccactttagttgttttttcaaaatgatttttttcttttttttttattgtaggctttgcacttctgggaggacatccttgttttcttaccacacaagatattcatttgggtgtgaatgaaagtctcacggacacggcccggtttgtaaatattttcttctctccaaagctgatttcagaatctgatggataaatttcaaaaataaaacataattctctttaaataatggttttccctctaattgttctgttctccattttccctctttccctgatattctgaatacctctccctcatcctgtggccactttccatcgg

SEQ ID NO: 785 - DNA, 437 bp, Homo sapiens
gctggtcactggataagtcgtgggaggtagaacatctggcttatgtaatgaatacatgtttaatattaccttttaaacctgtaatgttggtaggttttcatgtagtaaaaattctatttattagtatttcttgttattatttctgatcttatattaaataaggcattattaagcataattatcttagattatctttttcttggtttgccacagtgtattgtctagcatggcagatgcagtattggctcgagtgtataaacaatcagatttggacaccctggctaaagaagcatccatcccaattatcaatgggctgtcagatttgtaccatcctatccagatcctggctgattacctcacgctccaggttggtttatttatttgtcttacaaaagagcaaaatcaaataattcctgacttgctttaagtgaaacagt

SEQ ID NO: 786 - DNA, 443 bp, Homo sapiens
acgcctggatttcatctccttcatcccgtgccttttaggaacactatagctctctgaaaggtcttaccctcagctggatcggggatgggaacaatatcctgcactccatcatgatgagcgcagcgaaattcggaatgcaccttcaggcagctactccaaaggtagggaaactttttgccttgaaactaacccctctcttaaatcatcctcagatgcaattacccagtgacaaaaaaagctctcttccatttaagtatagcacaggtgaggccacagaatttaggttacgttaccagccctactattaaatagctatctggcctcttgagagtccaatttcccatctctacaataagagatagtcttggctgatgccttttattctatgagttagtgttaaaagcatgtctgaattattcctttgaataccctgctgtaggcca

SEQ ID NO: 787 - DNA, 405 bp, Homo sapiens
cggagatagtgaaagctggggcaattggttgtctctttaaattccaaaaggcactattgagttttggaattctagatgtaaaaatcatattctactgaacatggtgggaccacatcttgaaaaagggaaggagacgcgatattgaaaagaaaataatatatatttaagaaaacatgtataataaaattacctaaataagatttaaattcttcctcctttagggttatgagccggatgctagtgtaaccaagttggcagagcagtatgccaaagaggtatgctctttacatgtaaagctattattgccttttactgtcccatgaagttatttaaccagcgtgtttatgtatgctagaatggtaccaagctgttgctgacaaatgatccattggaagcagcgcatgg

SEQ ID NO: 788 - DNA, 360 bp, Homo sapiens
accaagttggcagagcagtatgccaaagaggtatgctctttacatgtaaagctattattgccttttactgtcccatgaagttatttaaccagcgtgtttatgtatgctagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaaggtacaaattgatgcctctctgaaggttcattaattccattcatgaaggccagaaccatctaatcacttattcactttagggggagcagactgtcctttca

SEQ ID NO: 789 - DNA, 350 bp, Homo sapiens
aaaccatcactctgctcctttgtctctccctttgcattgatgtctgactactggccatgtgtgtttttagatactgaagaaaacaaatatgactgccacatataatagtcaaaaagtggtcttatccccatctctttagactgctaaagttgctgcctctgactggacatttttacactgcttgcccagaaagccagaagaagtggatgatgaagtcttttattctcctcgatcactagtgttcccagaggcagaaaacagaaagtggacaatcatggtaagcaagaaacaaggaatggaggataagttctttgtgtggttccaacttggtcattcatgcctttggggaa

SEQ ID NO: 790 - DNA, 437 bp, Homo sapiens
tgccaagggttttcaagggctactattatagcctgttggtgggttcaagatactgcttaaaatttaagagatgtaaacatctgtaggtagctgatttcaaaatcaaattattaaggagaaatctatcaaaatgtgaagtttcacttgtgcaaatgtaacccaccacattctgatttttttccccagataacctggcttccaggggagtaggaaagtttcaaagacctgagggccatagcctatagcactccaccatccacccagggagagaagggacttactgtggcgagcttttcaatgtattcatcaggtgcacccagagaggcaaggccaatttcctgtaattgggggaaaatagaacctgttctgttcctgtaattggaaccacagaaccaacctagtacttggccataaaaaggtgatgggtggccagatgc

SEQ ID NO: 791 - DNA, 431 bp, Homo sapiens
tgggagccaaccacactttctggcatgtgtttgcatactcacaaggctgcatgcataggtcagccttggaatcaggaggccccttctccccagagatatgtgtacttgcaattccatttctatctgtaaaacccacagccatcatcaaatcatagctgctaaggtaccaatcactggagaatgagttcccaggttgcatatcaaaacggatacaaatagggtttcaacaatattgaaagcacaataatggttttctgtacccaccacttttaaatctatccttggttcctgtgaaggtcatacctgtaattcaccaaaggatgacaggagcccagcaccatatgcctttatggagtctccttgtttgcagagcccaaactccacagtaaaccagtaaatctggaatggaaagtcaatctgagagcacactc

SEQ ID NO: 792 - DNA, 423 bp, Homo sapiens
tcagcatgcccaaccttccaacagagaacggaagaaaaggagggtggagaacatgggagagaaactgtctatggtacaaagttgctgtagacattggagtccactctcctggccaaccacccacagatgagtggcaccagtcaggaggcccccagagctagtggctcacctttgtcaccacctcaccttactttctccttggcatcattaaaactctctgccacgtaatagaggggctggaactccgtgacagtgtaattttggatggctgtcttctccagctccagggggagaagctttggcttctctgataagcagtactgtaggccccaagtgaaaagttattatcactgttaaatcaggatcagtattccctgctgcatcccataggccatttgtgccccttctctcatctcaccccga

SEQ ID NO: 793 - DNA, 448 bp, Homo sapiens
gggatggagaggcgagggagaaaaaggaacatggcagtgacagaccaagtgtggaaaggtggaatgatggtaggaggtggagtggaatctaggaaggtcaaaggaaaaaggacacaagggtaattctgacctttttgtcaagttcttctccatcaatgaacccatggcttacatggaggtgcttttctccttaattaaatatttcaataaatttattatttttcctatggcgatggtagggaaagacagtcttcgattactgagaaaccgagtggcctcgtaaggtgtaaattacttactgttaatggaatcagccaaaatcttaagctgctgggtattgtccaagacctcaatcctttgggtgtatgggtcgtagcgaactgagaagggccgaggtattgtggcagcaaagttcctaagaccaaaaccacaggcttgagtgaagggc

SEQ ID NO: 794 - DNA, 444 bp, Homo sapiens
agccttatatgctcctttatgagttctctgcaaagcatatatgaagcttgaatgaagcaggtcccaaattttaattaatcttgatgaaatgcgacagattactgatttaactcaattgagagtatgggattatcatctctaaatcaaagatgaccccaaaagatttaccattatgctcttgagtatgtactcatatcctgtcatttcagattattttgacttatttgttgtttctccatcttgtaaaggatttaaggctgttatttcaaattaaggtttgcttttcggactttttctgatgaaagaaatagttggatctccatcaacagattcacagctgacagaccacattctgtccatggctttactttattttctggagggcactgcaaaggattccaatttcacctacaaagaaaaacaccatcaaaatgggccacttgt

SEQ ID NO: 795 - DNA, 436 bp, Homo sapiens
tctctggaggcccaaattcccctaactgagcagctcaggctgccgtggctcacctgtccaaagtcagagagtttcctgcccaagcctgggttttccaggaccgcagtggacatgctggctccccgggagtgaggtctctggctttttagggcctcaggtacaggcaggtttgcaaacagcacgtggggctgaaggttttaacctcgcactagggaggagaagagagttacaaagggtgtctcttgcgtggtgcatctccgcacagtaacgcccctcgtgggcgttgtcctgacgcaggaggccagggcagcctgccggatgctccaggtcacctgcccaggacgggccggaggggaggggctgagggagggtgtgggggacgcaggaggcaccacttcgctgcccgccctgggtaaagggaagaagccagggagcg

SEQ ID NO: 796 - DNA, 425 bp, Homo sapiens
tgctcccatatgctgagatctgagacatccaattgttgaaaaagagttacaaaatccatgaaagtacacaaataacctatcagaaaataaacttagtcttaaactaaatctcaaagaatgtccaggatctagcacttactacatgcatgtgacagaaaaccaaggttggggttagggctgacattccagagtttgctaaatcattagcctaagtcgaaaaataatacataaaattctatgtgtgtccacaataagcagcaggtacctaaaactgggaagaaaaaaatttgcagaacaattactctcttgtaagcaagttaatgaaattaatggaatagatgttacatcatctcaatgagagaaggctgtgttaggaaactcttagtgactcagaataacaagccctgcatgaatactgatgaccc

SEQ ID NO: 797 - DNA, 384 bp, Homo sapiens
agaacatggaagtttgctacgacattatccaagacaaacatgattgtagcactgacctcaaataagcgcaatactttggccaatgcaccaacttcttctttgagtgagaagatcagtgatatggcaccattttgattgcagttgtcttcaatatagcttgtttcctacaggataagatgcatttgtttaaaacattttccacagtttagcaattcattcctgttaaacctccatggacaaagcaagcatgaactctttcttctagttaaatcttgcaatacaatgagctatatatattctatacagaaatatgtagtgtggtggaaaataagtaagtccagggcaattaaatgatcaatgatgctactgggtcagttatcagct

SEQ ID NO: 798 - DNA, 447 bp, Homo sapiens
acagtgtggagttacttatgttgcaaaattcctctaattcttacctgtgtctttcttcttatctcgtgaaagctcatggacagtggcaccaatgtcatgcctcaagatcttgatgatgtttgtcagagcaggcaggctacgtttatccaaatgggtgaaaaattcatactcatctttctttaaacgagaaggtctagattcaatgtgggtcaggtttacatcattctcctagaagagagaatggggagggtgaggagacagtcactggaactaacgcaggccaaagatgcagaaccagaacaggaaaacctaacgcaacaaaatggagagttcaagaatacaattatttttataagagtataaaaaagtccttaaatttgcaaaagttgtttactttttcttctttaaaaccaagtactaagtggcaggaggtggggcagttagttc

SEQ ID NO: 799 - DNA, 427 bp, Homo sapiens
ttgcatctgtgtgtgtgtttgtgcatacacagacctagtatatagagacaatagtttctggacagtgatttatatttgctcctacaaaaataatgaccatgataatgatgatgacaataaagtcttgctaatttttcccagccctcgtgtaaataggaacacaataagtgtttgttgaacaagtgaacaagtacattgctccaagtagagaaggtaagaggaagggaggggagtggaggagaggcactgaaaaaatctcatcctacgggccatggactcacagggtggtcagcatccagttccgctccatagctgagaatctgattggcaaatctgtccagctcttgaatggttcttgggaaccagggcactgaaacacagagaaggcaacgtcctgagtacagattggcagaacatggccaaaggc

SEQ ID NO: 800 - DNA, 369 bp, Homo sapiens
ctggatgagggcaagggagaagcaggctaggggtgtgtttttctctcttcccctcaacaagcaaggcagacttactggcggtagttgtaggcaatgtcagcaaactgcttccgtcttgcacggtacacaggatctttaaaaccctaggagaaaagagacacctgatttttcaaggcttcataggaagaggtctggtacctttatgaatgctttgaatgggggctctcaagccatgacagtgcatgtctccttcccttggttataccctaaaactaaagtctcggttaaacttagctctcctaccagatattgtgagtgacaccttattagtaacttctttgatttagcatgagcctccttgctgtggat

SEQ ID NO: 801 - DNA, 430 bp, Homo sapiens
aaacacagtaggggctggagggaaggcagagcacagtgaaatttagttcttcctggaggaatcaacctgcatgcattcctacaagcacatgctttcatacttgcctccacatacttgtcttccccttccctctcctctgcctcaatcctcccccaactttctgcagggccattgaccctgatgtggacttactctgcaggaactgagaaacgtcttccagctggggaatgttatcttcatggaagccacagtacttttcaagaagtggaaaaatgtgattgtactcatagcaagcatgggttttatacaaggacttcagagtcttgaacactgtgccccatgttttcttttcttcctccatgtattccactcgagggatgggctgcccactagaatacaggcacaaaataggtgtctcaagcagggcagg

SEQ ID NO: 802 - DNA, 449 bp, Homo sapiens
tggatcacaggatgaccaaatctccaatcagtctggtctatctacttggatggagcaaatctccagaatagatgaattgtttttagtactaccagcaaacagtctagacaactagtcctgtggaccagccagcaatgaacccaaacctcattcttgcagcaggaaaagatggcgctcattgtgcctggcaactggtagctggaggacagtactcacggttcgggggtatacatgggcttggatccatgtctgatgtactgtgtgcagtggaagactcggaaggccaggccacccaagaaatcccgagaggaaagcaggccagccacaggtcggaggcggaaaccagtgcaagctgggatgaaaagaagaaagaaaactcaaagctcatcaccactgagtcagaggcactaggagacctttaggtagtggagtagtacacataactgccc

SEQ ID NO: 803 - DNA, 431 bp, Homo sapiens
tgtacctggtttccgctcttgcagagggcatgaggacccctccctgggctcaactcatttgagaaattcaggtcacagacctataactagaaggctaaaaaatccattccttacctgggaaaactgggcaaagctgcgatctgaaaacaagggcacatgtcccaacagctcatggcagatgtcactgaaagacagaaagcacagagagctcggaggggaggaggtttaagccaagccagactcagtctttctacatgaggaatgggcagaaagaatggaaataactcttttaggcttatgatccctctcccaggaataagtgatatgcagaggttgggatcataaaaggcagggtacaaggtaaaaagaagaaaaggaaggaaaaataagagacaggtgcagggtagggcacagcagccaagggtcttaag

SEQ ID NO: 804 - DNA, 396 bp, Homo sapiens
actcgaaaagactttcccccgccccttcccgctcccacctcgcccgcggctgccccggccccgctgccccgatcgcggccgcgcacccctggactcaccatggcgcgggcggcagcaggtggccagcggagagggcaggcggcggccgggcgcgcaggctgccgtcccggggcggggccgcgctcgggccgccctccggtaatgattaacgtccccagccagggacgcgctcggcctgcttgcttccagcactttcctcgctgctcagagccatcctccgtgcttgtttcagggagctagggtgaagcatgagggctccaaatgcccgcttctgggttggaatcccaccccgccgcttacagctgggtggccctgggcgccagaatacctattttt

SEQ ID NO: 805 - DNA, 436 bp, Homo sapiens
ggagagcccaagacacatcctcctatggctctccaatccccaaagatgatactttctgagttagacaggaaaattaatttccccactggcacagtgcccaaataactggatgagtgtggtgtctgagagtcttggctaacaagacgtgaagggagagaacatgctttgtaaggtgaccccatcagcccgtctcagaaaactctgtcccaccctggtgccataccctgttgaagtctttgaaatgaaactgcttgaagatggcatcacggccttccagctcattccaccccacagccctcaggtttggcagcagctggtccctctcctcagcgctcagcctgtgtgctttgccagcctagaagagggaaaaaaacagaggcccaagggcatttctctttataggtcaaaacagaggggctccaacctttaggggaac

SEQ ID NO: 806 - DNA, 406 bp, Homo sapiens
tcgcagtatttggatgggggcagagcacaacagaggcacacagcatcactcaccttgttgtacacgttaaaccattcaggatggtggtccagtttctcagcctgcagggccactcttgtcatgaacccaaaggcctatttaagtggagtgagagccaggttagtgttctaagagaaaggacttctggacatcaccaattcaaggcctagacgcaggaggatgaattagcttccccccaggagactcctctataatcatttcccccttgacatcctgtcactggttctcaggcttgagttagagattgtccttgcagtaggaagaaagtcttgctatttaggatgtcaacaaggtggaaacaccacaacaggcttttggcctggccagtcttggccgtctgttcaaa

SEQ ID NO: 807 - DNA, 441 bp, Homo sapiens
acagagcccccaggatgaagagagtggtgcagggaaaaggtctaaattcctggtgttggtggggacactggcacatcccacagcaaggactcagccctcaacggcggcggctgggtcttgggaggggagtggtgggagggtaagggctcctcagctccctccctggactcccagttcagtcaccccttcccccggaagaattcaaagaggaagggcagggtctatgtcatggacactgctacttgttcgatgaagctggccaggtttatgtcccgttctgaaaggccggcacactcatgggtgctcagcgtgatgtggacctgaaatgaaaccagaaattctgcttccactgacttcacttaagaacaggagggagtcactagctgctgggctcagccctgctaggagctccagaatagcagctggccagtacgatctctc

SEQ ID NO: 808 - DNA, 428 bp, Homo sapiens
tagctctatttgttttgttagtctgactcttcttctccttcttccccttccccttcccctccctctccccccctcctccttcttccttctttttttcacagggatggttttagattgtcatctcaagaagctgcttctagttttggcgatgatagactactaatagaaaaatttattgataatcctcgtcatatagaaatccaggttggtacatttaagatgctttttcattattattttaaaataatatcatttaatcctattggaattatcttttcttccatttagaatgattgtgagttgtgcctttagaatctgttgtactttccgttaaagtgctaggatgttggttgggattgggaatgatacaaaaatctacctccaaaaaatgcattcctaagatagccgaccaggctaatctccttcca

SEQ ID NO: 809 - DNA, 441 bp, Homo sapiens
tccccttcactaacactcagtgtccttcacaaaatttgtacaactgattctgatgttttactcgttgtatttgaaaggtgatatgaacactttttcctcaaatctttttgataaaaatgttttattgagctttggagtaataaatatagttttcctttgttaacatgaatcaaaataatgttttgagaggtatgtatatactatgaagtttgaatattaaaaaccaagagatgttgcatgcggaaaatattaaccatcatctactttgtgggtgtggttatatggtttttcaaatggtattgctctttcaggttctaggtgataaacatgggaatgctttatggcttaatgaaagagagtgctcaattcagagaagaaatcagaaggtggtggaggaagcaccaaggtaagtctcctaagaaacatttataaagcggctgc

SEQ ID NO: 810 - DNA, 450 bp, Homo sapiens
tggattgaagttgcagagtaatgtgaaaagttcaaatgttttatacaaatctaaagttgacttatttgagcatgttatgcttaataatatagtcaacatatattataaaacatatataaagcacaatattttgaattcttaaattggtatagatgatctatatctgagtaaactttaagaaaatgtttatgtaatgcacacaaaagataacttgatttttgtccgaaatgtagacaaacatttttttgtatatgtagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggtaacaacaactgttatttattcctctccatgcctctgtact

SEQ ID NO: 811 - DNA, 419 bp, Homo sapiens
aggaccctgaatacacctttccaaattcgtgtgtgtgtgtgtgtgtgtgtgtgtctgtttgtgtgtgtgtaattaataatttccagatgctaggtttttttttagatttaagtgttttggaaaagcatcctctgtatagtctacaaagtctataggagttagaaaattcccaaatagagaggaataaaatcttaataagtaagtaattaaaaccccaaacatggtcagtcagctgtccatatctttgagaacagacaggtaaactgtcccacttttgttagacttagtcagttgcttatgttgattggtacagtgcaggaggaatctacttttaccatggaaggaaaggtacagtacaattgttgaaattctgtgaaggctatacactctaatctcatcagggggaattctgcatcaca

SEQ ID NO: 812 - DNA, 447 bp, Homo sapiens
acccttttctacacctactgactggcagaccttggccttgcaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggtaaaatgaatggtgttgggaggaaggatggtggttatgtccagagtcatgagacctggtatagccaaacaatgaggtaaagttagggttttataatgttgccaactattggattacgtaatccataattaaatcagaaaaaaattagataattttgacctaattccagatagttttaaagaattgggcttagttaattgtcatgtatttgtagatggggaaatagctaccaatcctttaagaggcaacagagcattggt

SEQ ID NO: 813 - DNA, 382 bp, Homo sapiens
acaaggtcaggctaaattctgcttacagttctgtttgatttttaagtacattctaagttgtctagcgtaaaagacaataatattctgaaatctgtgatttggtaaataccatatgttgaaaatagacctataaatggttcttcattgtgtaaatatttaaccttacttgtgctgatttatatttcaaagactgtgcttcctttcctttgaactttcaggacccctacaagtcttttggtttaccatctattgggagattgtctcagtaccaagaaccgttacatctacctggtgtaagtcattaagctgtaataccagctgaagggttaaaatcgtgatttatgtcatacttttatgttaaagcatgtcaacaccaaagggt

SEQ ID NO: 814 - DNA, 377 bp, Homo sapiens
tttggggctctttaatgtggggaaaaggtagattgtgattttattgcttttaaagctgctccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaataaaagcccttcaggtatgttatagtgttccttttacaaccttacaaagagaataatagtagtgtgaattttaagaaaatgaaactatcgcttgtcttctgatgtcaccgt

SEQ ID NO: 815 - DNA, 424 bp, Homo sapiens
gccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccattttctccatggaaatgaaattggtggttacaaaaaaatatctacacaatatgaattacttttctttttttctttttttctcccaggtccgagtggacagtggcatccaaccaggaagtgatattagcatttattatgatcctatgatttcaaaagttagtttaatttctcaatggattatttgatttcttcgaaaaatcaatgatatttaaagagtctgaaactgggccttt

SEQ ID NO: 816 - DNA, 448 bp, Homo sapiens
ttcacgtttagctgtatctccttttaaattttttctgtacttacttttgttacgtttttgtttttgtaaaatcactctttactatgataatgaaatgtaggagaagagtctgaaatagcttgattctaatatttatatacttaaaaaatcataattgacatgtattgaaaactgaactatcataaaatttcgagatatatttagaaatctgttatgaaatattttaatttttactaaaatgaatcatttaacatagttctaaatatatatatatattgggttttttgtttgcttgtttttagctaatcacatatggctctgatagaactgaggcactgaagagaatggcagatgcactggataactatgttattcgaggtaaaaacaaagatttgcactcgttggttattgtatatggtgtccagttccagagaacagcctgggggtt

SEQ ID NO: 817 - DNA, 361 bp, Homo sapiens
tcttgaatggtttctgctaggtcatagaacagtgatgataaatttctccagattatcagaattcaatttttcactgattcattgttcttcaatttgatatcattttacttttaggtgttacacataatattgcattacttcgagaggtgataatcaactcacgctttgtaaaaggagacatcagcactaaatttctctccgatgtgtatcctgatggcttcaaaggtttgtatgcattaaaatattttagtgttttaaagttgttatttttatactttattgtaatacataatttcactctattttgaaattaaggccttttggcttatattatacttcatttttagaacatgcaagactg

SEQ ID NO: 818 - DNA, 356 bp, Homo sapiens
ccgactagccctccaggtcctagcgcgactcccggatcccggatccggcggatctggccgaccactcaccctcccctttccgcaagttagggggcggggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaaggtgaggagcaacggggcctcgcgggtccgggcttcactgggcttctag

SEQ ID NO: 819 - DNA, 411 bp, Homo sapiens
ttgcttggcccctcgacaattcttgttttgcttttctggagatcgttttgatgcttttggtttctcttacataccaaggggctgtgtctgtagatatgatttcccttttgtaattatatttatggtatattgcctagaactacatttattgatcagacacgttcgctagaacctaactggaagaaatatcctgaaaaaatgttctaaagcccatcaagtatttgcaatttattttgctttcctttttttgtagcatgttctgtactattcaagacagtgcttaatggtgtcccgtaatcttggttcagtgggatatgatcctaatgaaaaagtaagtatttaaaagatattctcaacaactaaattaaacttatcatggttttactttctcgtctccacactgtgttcagt

SEQ ID NO: 820 - DNA, 435 bp, Homo sapiens
aggagagaagcacagatgttaaaataaatgattgattgattgattggttgattgatttccctcaggacacatgctaaccaagagtgagaagaaccagttattggcaatagcatcatcattgtttgtggcattccagttaagagcacaacattttcaagaaaattcaaggtatggtagatcatttaaaacagaataaatgagcagaacaatattgataatccagtctacataggaaatactaataaaagatgtggctgatctcagttctagagatcttatgggtctttggagaagtataataaagtcacactgtataaatatgatattgcttacattttgtttaaacaagtttttttaagttcagaaaggataaaaggatcttggcccttttaatttggacataagaagatagtctgaaatccgatgggaaatcca

SEQ ID NO: 821 - DNA, 428 bp, Homo sapiens
tcaatggcagttttagcctgtgcattttatatcaaagggaaattagtttattgagaaataataatataaaattattaactctttttcttttcattctacttcagaatgcctgttattaaaccagacatagccaactgggagctctcagtaaaattgcatgataaagttcataccgtagtagcatcaaacaatgggtcagtgttctcggtgagttttctttctttattttcttggtaatcttgatgttatctatgaatatttaaagccatttttaacctgttcagtgactctcgtcttttgaatttgtagtacctctatgtatttttcatcttctttaggaagctgaatggaaatggaaatttttgttctcttatgcttattaggaaatacatttctagatttagccacatcctaaactcactttctga

SEQ ID NO: 822 - DNA, 403 bp, Homo sapiens
tcacttgaagcctcagtacccggaggcagctgttcacaggtccttcacctctccccagagatgactgggaagacgctgttgttggaccctgtctttcttggctggagcagtaaacatgacaggttgtttgggagccatctgtttaaaatggctgctgctttgtatgcagcaatgaacttgagatcagttttctgtctttcttcatggtaatggtcttatttggtgtcacaacaggtggaagttgatgggtcgaaactaaatgtgaccagcacgtggaacctggcttcgcccttattgtctgtcagcgttgatggcactcagaggactgtccaggtgagtgttgtaaggatttccttagagggcctcctcaagtccagaatccttgtcagcacctgtgtggcta

SEQ ID NO: 823 - DNA, 446 bp, Homo sapiens
tgtcctcccagacctcctcttggaggcatctaccaatctaccttccatctccatggattttactattctggacatctcttattaagtggaatcatataatgcatgatccttggtgaccaacttctattgtagcatgtatcactacttcattcctttttatggccaaataatattccactgtatggctatactatattttgtttacccatccatcagttgatggacatttgggttttttggctatcgtgaacattacatacaagctgtgcagatatgagttcattttatatctcttgtttgttttttagtgtctttctcgagaagcaggtggaaacatgagcattcagtttcttggtacagtggtaagtatgaaatcattctttattctcttaatttacagagaaaaaatgttcaactagttgtagctcatgtgtttgaacttggct

SEQ ID NO: 824 - DNA, 369 bp, Homo sapiens
taatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttctctattttttaaaataaaaatattttagtgaatatgagttaaatgagaatcaagtggcttctgggcctccctgaaagatcaagtggaagcactggatgactctaatgatgccgaattgtaatccataaagcacctgggcagagttcaatca

SEQ ID NO: 825 - DNA, 444 bp, Homo sapiens
tgatgtgtgcagcaattgagaaccatttgaatttaaggctcttactgtaatttgaatttaaaagctaaaaattgatttagaatgaatgctacttttgaggaaaatttcatttaaactcatttatggtttggttttgtttttcccttaagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacgccccctaaacagcaaaatcgattgcgtgtgttgtcgacct

SEQ ID NO: 826 - DNA, 441 bp, Homo sapiens
tgccttgtgccttgttgtgggtactcgctgtgtcttgcagaggatgggacagtggtcctcgtggcgccagggccgagctgttcccagttccccgggactatagacagaaatatgtatatttggtggtggttttttttttttggtaacagctatactgagatgtaattcacatacaatttagccctttaacgtgtacgattcggtggtttcagtcaattcagagttgtgtagttgtcaccacaatcaattttggaacatttttatcactctcaaaagaaaccctgtacccttcagcagtgactccccttccctcttcaaccccaggcaacctcgagtctgtctgtagagatctgcctattctggacatttcaggtaagtggaaaacattccaatttccgaacacctctgttagtggcagagccagactcagagatccccagg

SEQ ID NO: 827 - DNA, 402 bp, Homo sapiens
cccacttctccagggtcagggattttttttttttccaacgaggactttatgagagagagaatggcttttctctactgttcctaaagatgagcttggaataggaaacattagagattgttgctgctgttcatagacacatattttggggcatttgacaaagaatttcttaatggcttcattcctaagtgttaatgcaaaattagaatgcttttaaaacttctgcccatttttgttttccaggtagcagaaggtcaagaaatttgtgtgattgaagccatgaaaatgcagaatagtatgacagctgggaaaactggcacggtgagtccctaagtccccatcagcccaggccggccctgtgatggaggaacgcccacctttgaatcgtgggtggtttggctggaa

SEQ ID NO: 828 - DNA, 435 bp, Homo sapiens
ttcttactctcccctccccctgcatttttcaaaattcaaggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaatattagtttgccctttctttgaatgaagacaatgtacacataggcgacaggctctgc

SEQ ID NO: 829 - DNA, 436 bp, Homo sapiens
tgtagttccctggttgtaaacggttatactatttaataacctattttaatattaccctaagtatttatagtacatttaatattactgtaagtaatatagtatttaatgttactctaggaagtaatgtttattagggttatattcagtgttgatgttggaaaaacttggtgttttttggtcttaaaccatcggtttaaaagtaacaatttctaatgaatgtgttttttctctcttcagacttttgataaaattcttgttgctaatagaggagaaattgcatgtcgggtgagtagaattttcgtcttattttccattttactctgaaattatttattaaacccctttaagtgtgaatcactattaatagacattaatatattttaaaataggttattagaacttgcaagaagatgggcattaagacagttgccatcca

SEQ ID NO: 830 - DNA, 441 bp, Homo sapiens
aggagaaattgcatgtcgggtgagtagaattttcgtcttattttccattttactctgaaattatttattaaacccctttaagtgtgaatcactattaatagacattaatatattttaaaataggttattagaacttgcaagaagatgggcattaagacagttgccatccacagtgatgttgatgctagttctgtaagtatatttttgctttgtttaaatcaggacttaattttgggtcaagcagaaaaagtgagacatacaggctttttttcttggcctgcacaagatacattcaagtttaaaaactgtttacttgttcactgttgtgttaagcaaaacgacagtatcacagtatcttctatatgtgccgtaagtattttcttttcatagctttaaaaacttagacagaaaaattgccaggctgattgctggtcaccaagt

SEQ ID NO: 831 - DNA, 397 bp, Homo sapiens
tgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagt

SEQ ID NO: 832 - DNA, 423 bp, Homo sapiens
ccagtgggcaggaagctatgtgggcatatactccccattgtggttaggacaaaggtagtgtgtggaaaatgaatcagttaggacaaagggagtgtggagaaagtaaatataagaggcagtttcttggaatttgattctgatcctagaaatgtgagttagaactgatcagtgtataagagaagtgtacttattcaagggctcttgaacagtaaatattaatacataaatgcactgtacattttgcttataaagcttttgcaatatgataaaattgaaagtgctttttgctttcatttctaaggtacatccaggttatggattcctttcagaaaacaaagaatttgccagatgtttggtaagttggtaatgaaccagaaactgttcatttctttttcagaaagcagtgtggtagcatggctttgt

SEQ ID NO: 833 - DNA, 440 bp, Homo sapiens
tccgaggcacactgtttacccagaaggagttcttcagtgcttttggttgttttcatttgactttgttgcatgcatctatccacacatgtactatatgcaatatagtattttaatgtgttggctcaaaaactgttgtttctgcaataaaaataattagaaaatacacatatgggcttttcttttataaaattgtgactccacatcatgctccgtaatgttcttgttataaattttgacttgtttttctccacaggcagcagaagatgtcgttttcattggacctgacacacatgctattcaagccatgggcgacaagattgaaagcaaattattagctaagaaagcagaggttaatacaatccctggctttgatggagtagtcaaggtgagaagctactttaacttttattgtatatgtcttcaagttaaacattttgtca

SEQ ID NO: 834 - DNA, 351 bp, Homo sapiens
ttctggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcaagggaaattggtaagtccttaaattaactttggtaggatttctgtgtctttcagcagatacggttgagtcaacaggt

SEQ ID NO: 835 - DNA, 447 bp, Homo sapiens
tggtcaattgtcatgttcatacatcccaatgatcaaagtctgaacttctgtctaattcttccctgctgttaggctaccctgtcatgatcaaggcctcagcaggtggtggtgggaaaggcatgcgcattgcttgggatgatgaagagaccaggtgagaggctgtccaaaatatacttttgatgaaaattgcagttaccagagttttattaaactgacaggtaaacagataccaaaagcataatggagtaattacagtaaccatctaatttttacacttttgaatgggaaaaagattgaaattatgtggaaaccttccttatttatattttgatgatgattatcttattatagaaagggttttactgttttaaacattaacaaaggattttctttttgtttttaccgtatatttttaaaaattacagtcaggattctattttctgggca

SEQ ID NO: 836 - DNA, 354 bp, Homo sapiens
aaggcagggaaaacttgggtctttagtttggagtcgtatctttaagctacatcctatcctcattcagccacgtcactatcttctctgcatttgtcatcttggctgaatcaactctaaggctgtgaccagctctggtgctctgaggttgactgttctggaaatcttttatttcaggacacctcctacctgttcatcactggccctgatgttgtgaagtctgtcaccaatgaggatgttacccaggaggagctcggtggtgccaagacccacaccaccatgtcaggtgagaggccttgaagatgaccttgttgttttcaaacattgagaagagggcattgccaaagagcctggtgg

SEQ ID NO: 837 - DNA, 365 bp, Homo sapiens
gtggagggtgcagagaacagagctatcagcacggtctgctactgacatgccctagaagggcgcagtcaggcatgaagcagcaactttgggctggctggtaccctgactcaatcatatatgctccctgttctcttaggtgtggcccacagagcttttgaaaatgatgttgatgccttgtgtaatctccgggatttcttcaactacctgcccctgagcagtcaggacccggctcccgtccgtgagtgccacgatcccaggtgggttgtaggccggtgcaccttctctcattttgcagtgtagcttgcctttctctgccctgacaggacccccagggtctgccttgttgggcaagttgcagcagagtg

SEQ ID NO: 838 - DNA, 412 bp, Homo sapiens
cccaccccattcccacaaaaggtaactggctcttcctatgttgactatacctgccttttttctgcctaaagtgaccgtctggttcctgagcttgacacaattgtccctttggaatcaaccaaagcctacaacatggtggacatcatacactctgtaagtgccacatctgtttgtcttgcctgtcctagtcagccacattcatgggcattgtgcttcggcttagtgaggaagcactggaccacttggcctccatgtcagacagcacaggtcgggaatagggtgggcacaggaccagtggccactgagtagtgtgttctggaaagacctagtggctatagataccctagtggcacagatggacttgagggctggagataggagtagtaagggccagcagagctcaggagtcttt

SEQ ID NO: 839 - DNA, 387 bp, Homo sapiens
tccacaccatttctccccagcagggaggaggtgctgcctctgcctgttgtcctgcttccttggagaacctgtgatagagctggagctgtctacctctacctctgtaattctgtaatagaaatgtcattctgtagtgtcattacatcttatacttgtctttaccattttgagctcagaagtaaatttattcctgcaggttgttgatgagcgtgaattttttgagatcatgcccaattatgccaagaacatcattgttggttttgcaagaatgaatgggaggactgttggaattgttggcaaccaacctaaggtggcctcaggtaggatggagctcttataagccttggttttggggttggaggccagggaagcctgggtccatggtat

SEQ ID NO: 840 - DNA, 377 bp, Homo sapiens
agtaattgagctcctactctgtgctgctttatagattccatttcctttactccttggaactatgctaggaggcagtatcgtccctactttgcaggtaaggaaccttaggtcaaaaggcaaagtaatttctcaagggcacgttgccatcatcagtggagccagaatctgattggaagctctgaggactctctaagaccagcccttgaatgctgcctcccactgatggctccctgcggcaaggccggctgtgtctcagctggcggcagccctttggtctgtagtgagtctgtagtagtctagttctgggcctctttggccagtgacagacaggtggattcttcatcttccctgtttcctggagtttgaggggtccttgt

SEQ ID NO: 841 - DNA, 354 bp, Homo sapiens
agctttggatggctgctgaggacaaatccccattgtggatagaactgggaattgcctggatactcagtatggataatctctctctttctaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctc

SEQ ID NO: 842 - DNA, 353 bp, Homo sapiens
ttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggtgaggacctcatgttggaggccatgaccctgctcacttt

SEQ ID NO: 843 - DNA, 450 bp, Homo sapiens
cttacagaccgtgggccttcaggagcccagtagggctattcttgttctttgtcccaattttacctggtttcctggggtctttcagggacatgatctggctgtctcaggctctaacactcagcatttggatctgttttaggcctatggaggtgcctatgatgtcatgagctctaagcacctttgtggtgataccaactatgcctggcccaccgcagagattgcagtcatgggagcaaaggtgagggcctcttgcttttccctttctgggtccaaggactcgactctaccagcgagagctcaaggcatagctgggaaatgttggagagaggccagggcccctaggttgagccaggactgaggtgaatgggacctagaccttggtaagtctccctcttggggctccagagatagctctgcctcctgtcctataccctttcttcaggcccacgc

SEQ ID NO: 844 - DNA, 414 bp, Homo sapiens
ccccaggcagttcctccctctatgctatggcctttagagatggcacttcccctcagtacactgatttaccaagaaatttgcacccacacacagtgataatgagttgaaggagatctgtccaggttgggacgaccaaagatgttcatgaactcctctaatcacagggcgctgtggagatcatcttcaaagggcatgagaatgtggaagctgctcaggcagagtacatcgagaagtttgccaaccctttccctgcagcagtgcgaggtaggggactgtggtgaagagggcagctttgtttgtttggtcaacttgctcattctttctctacagaaattgtcacataactgcctttttgcctttgcagtctaatctgttgactagtgagggttgggactgtccctgggcagtcatcac

SEQ ID NO: 845 - DNA, 440 bp, Homo sapiens
ctgagcagaaggttgaggggtggcatcatctcgggatgcagatgatccactcccttttctgtgcttcaccagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctcttttgtgccttactgtaaaattatttacttttttaaacattttaagttgtattttttgagcataaattcgatttttttaggtggaaatctgaaaaatcaat

SEQ ID NO: 846 - DNA, 450 bp, Homo sapiens
tctgctatggtccataaaagagtacatacaagctcttttttttctttttggaggtaagagtccaagaagtgtttcaccaggttgtgcagtctggacaccgagatggtagaggggctgtaagatggtagaggaaccagctcaggagagcagctgggctagcagctttacggaagccttggatggtggggaaactcccgtacagaaactcagctggtcaaagaaactcaaagccacaagaccttggaagctttgtcaagtggaccagcctccatggaccacggaataccttgagagtaatgacagttgagtgttctcttgtgtgggaatgccttccccagctggtgccctcaccttaaagggaaaaagaaaatacactgaattttgtaaatgggaaatacttgggtccactgagctgatagctgacaagtgtctgtctttaaactgagagca

SEQ ID NO: 847 - DNA, 443 bp, Homo sapiens
cccgcatgattctcttgcaaagcagtaccaacagatggccagtcatctttttgagttgctagagtaatggggagcacatccacaatacacccttctaatgcttgttagaaagtgcttttgttgcaaagttcttctagcttctttttttgaccctgtcttggtctccccagcccaactttctgcctctggttgcactgatactttgtcctggtgctggtgcttaagatgtggtctgctcagccaaagaagtctgtgaaggatactcacccacatgtggagttgatgaatcagccctcttcacctattcaacagatgtgactgttttgtctttctggttccaaaggatttctggagagctatgactttacccttttagaagtattggtcctcatactctgtgcacctctgatgtcagcatgggatttctacaattccaagcagga

SEQ ID NO: 848 - DNA, 429 bp, Homo sapiens
tttttctctgcgcgaccctcctcgggcagcaccgggtctcgaactctcacgccttactcccaagcaggttctgtagtccagcccccgcggctccctacagccagccgatgctgcgcaagcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgagtgagtcctgaggggcctaagtgagtcccgcccctggcgtccgcgacctatcactgcgt

SEQ ID NO: 849 - DNA, 353 bp, Homo sapiens
tgatgggtagcaaaggcacgtgtcggaagcaggtggcctttctgggagtgcgcaggctactctcgatgtttggctggactgagcagttgaaacactgccacccaccgcctgggttttgaggcgagaatccagctggccttcagagataagctgggcggcccattttggagaggtgatccctgacttgaaaccaggcttgcccagtgtgtccgtgactggtgggtgagtctggaccgttgtgctgaacgaattaaccaacgggaaggtgcagaagtgaaactcttacagatgaagagtattcaggcacaactcacaaccatgagggaggcactgggggagggatggggtcttaa

SEQ ID NO: 850 - DNA, 376 bp, Homo sapiens
ggcgcacactgtctgtcctgatttccatgtcatctaaagtctactaataacacctatctgccttgggcaggttggatagaatgaaagtacttgcattgagatcaacgggcaaatctgcccttcaagccctcccatgaacagcccttgctttgcttactaaattgtctgtgatgacatcactgagtgatctttgttccattgtagggaaagctaacagccagggagaggatcagtctcttgctggaccctggcagctttgttgagagcgacatgtttgtggaacacagatgtgcagattttggaatggctgctgataagaataaggtatttgttcaaatggtggtgtgaacactttttaggtgtggctcagctggcc

SEQ ID NO: 851 - DNA, 368 bp, Homo sapiens
ctgggaaagtggggtgggattccttcatgttccttgttcatattgacgttttaggaatttgggttttgtttttgtctttcattgaggcatagtggccaaactcattagaagaagtatttggattttttaacctttatttttgcatttttctggtagtttcctggagacagcgtggtcactggacgaggccgaatcaatggaagattggtttatgtcttcagtcaggtatttcataactccaatagtctgaacttttcttggagggcagagccaagaggaaaatatgtgaaagaagccaatcttggggaatgaaaacttgcttgtagtttggggaaaatgagggatttgctttgcttttcagtgcgtgt

SEQ ID NO: 852 - DNA, 409 bp, Homo sapiens
agcagaagaagcagtgagagctctgattcttgttttttaacctttctttttaaaacagcaaataataggctgggcacagtggctcccgcttgtcatctcagcactttgggaggccgaggtgggtagatcacttgaggccaggagtttgaaactggcctagccaacatggcaaaactgtctctaataaaaatacaaaaattagctgggcctggtggcacgtgcctgtaatcccagctactcgggaggctgaggcaggagaatcacttgaacctgggaggcggaggatacagtgagccaagattacgccactgcactccagcctgggtgacagagcaagacttggtctcaaaatgataagtaaaataaaacagtaaatatttcttaaaaacagaagtgcttgactgtttga

SEQ ID NO: 853 - DNA, 450 bp, Homo sapiens
ctggaatacagtggtgctgtctcaactcactgaagcctctgtctccagggctcaagcaatcctcctgcctcagcctcccgagtagctgggattccaggcatgtgccaccatgcgcagctaacttttttctatattttttgcagatacgggcttctgccatgtcgcccaggctggtctcagactcctggactcaagccatccacctgccttggcctcccaaagtgttgggattacaggcatgagccaccacgcctggcctaaaaacttttatctgtgaattttctatttcttcctcccactgggttttcatctctagccagtcactatatttgacttgctgatttgtattttctttttaggattttacagtttttggaggcagtctgtcaggagcacatgcccaaaagatctgcaaagtaagtgtttaatactcaaattcaatccattgct

SEQ ID NO: 854 - DNA, 422 bp, Homo sapiens
gctttggctcttgggtgtttgggggctttaatcagcctattaaatatctggtcctttgtcttccatgaaggtacccaatcgtgatggggagtgaaaccagtgttactgcctcctgttttgaaaagtgcactcagaacgttttccagaaaacactgtggtattttgtgaatgtcgttttttatatcaagaacatttgtctcaataaaagatttctctgctgtctcagatcatggaccaggccataacggtgggggctccagtgattgggctgaatgactctgggggagcacggatccaagaaggagtggagtctttggctggctatgcagacatctttctggtgagaaacctgttaatagagaataaaaaaatacagggcttaagttctctaagccatggcctggccagagcttctccaactc

SEQ ID NO: 855 - DNA, 388 bp, Homo sapiens
ccaggaggggaggggagagaaaatacttgcctcagaaagtaatatgctgaccatcctaccagttacggggagaaaatgcacatataattcttaaagaacttcactgattaggtctgttgcctcctgtatagaatttctgtgggaaaaaagccaaatgttatcttattgttgtctttatctttccacagataatgcctcaaacatctctgtaaccagatgcttttgcttttctgttttggcagaggaatgttacggcatccggagtcatccctcagatttctctgatcatgggcccatgtgctggtggggccgtctactccccagccctaacagacttcacgttcatggtaaaggtaagaaagaagggcctgtttttggtgccgtttga

SEQ ID NO: 856 - DNA, 416 bp, Homo sapiens
ggaccctggcagctttgttgagagcgacatgtttgtggaacacagatgtgcagattttggaatggctgctgataagaataaggtatttgttcaaatggtggtgtgaacactttttaggtgtggctcagctggcctacccactagaataataataaatctataaggcttttatctgaagtcctctgcagaggcactgcagacatcaagcccagataatttttgtatttttagtagagatgggctttcgccatgttggtcaggctggccttgaactcctggcttcaagcaatccacccacctcggactcccaaagtgttgggactacaggcgtgagcgaccgtaccctgccttgtgtttctttatacgtcctccttcatgtaagcatagagaagtggtggccctgggtcttgattgtt

SEQ ID NO: 857 - DNA, 442 bp, Homo sapiens
gcaggtccaccgtgtccatcatacactgcaaagtacaggacctcatctgtcagctgagcgaagtcaaaccgatcttcattctctttccgtttgccaatctgtgaggcgcaccccacattttccaagctgattttgggaattggcttgccatacttaatgctgggtggcagcagaattggctcatcaatgcggttatcccagatcccaaaattgtcccaggtagctggactcccactaccatctgggtcaaaccgagaacacctaggctctgaagtggagctgtggcacgtgggtgtcacccgcctgtcgtcctgcagcaggcgggagcttagcagcactctccttctcacctggttcccaccacttctgaccaaagtaattaaggcagctgttgacataactcagctccaaaggactcagtgatgagggaaaggtcaatgga

SEQ ID NO: 858 - DNA, 435 bp, Homo sapiens
atctgtcctacactgatgggagtaaatgcttctcataggttatctcatgtacattatgccacttcacttaaaatgatcacaaattaagtgctatagattttggttaatgctttccccaggggagttgttaaaacatgcatttctgaaattgtgataaccataagtaataaatggcacacttaaactactgctcattcgtgaagcagcagcatgcaaccactcaagtaactatgtttacgctggaagcctcagccaaagggtgaaagtttaagtaggaagtataggaactgcaaagtcaggagtgaaagtcattgtacatacataatacatttctccatgtgggtatgacagaaatcagctgctgcaggtccaccgtgtccatcatacactgcaaagtacaggacctcatctgtcagctgagcgaagtcaaaccga

SEQ ID NO: 859 - DNA, 438 bp, Homo sapiens
tttactcctcccccaccccatgtactccctaggatccaaggaatgtgatagttttacataccatcagcagacaggcgggcatgactcgaaaaggctttatctatttctagaaaagccaaggtcaacagagtttccaagttcttctccttaggaagcaaatccctttgtggggaggaaaaaaagagccttaaacaatcattttacaataggtttttctcctcactgttactctagctagcagtcattccacacaacgggcctcaggattttcctgtcaaatgctgaagacctactggctaaggaatacctattgagaatccacaaagtatcaggcactgtgataagcttttaagggcacaacaatgaaagtccaagtccttgtccttgaagaattgatcctcactaccacaaccctgagaggtcgagagttccttccca

SEQ ID NO: 860 - DNA, 441 bp, Homo sapiens
tgtcctcgctagatgtgattaccctgtagtgtatttcagcacttggtcaccagatccatctaaaaaaaaaaccaaaaacccaaaacaaaactcatagtatggacattttgtccataaaataagcaaacagattaaacatttttaaaatcttttaaaaactaaagtacaacatcagaactgtttcggggcttctctttctgaaaaattctccaatatatttcatttaaaagtgaggtattaacattaattggagttcccaacagcatttaatgtgattcttcatataaactcatttctacataaatccttacaaacaattgtccattaaaatcccctcccccaaaggacttaaagtgtttcctttttactcctcccccaccccatgtactccctaggatccaaggaatgtgatagttttacataccatcagcagacaggcgg

SEQ ID NO: 861 - DNA, 438 bp, Homo sapiens
accaacccaacttcacagttccaaaatcccaggatttataggaaaggcttcaaaactaactgtcaattctgatttgctaagcatttaagaatgtaaatattaaatcagcattcattttcatttaacatttaacatggaagtaaaaattctcactttttgcctaacaacaaaactagaaaactaagacatctttcaataagttcttaacactcactggacaatttctactgcaagtcatctcaactaatgggacaaagagatgtgggaaccttcccgtagtccaggataggaaccgctggactccttcacctgggacaaaattaagcagatctctctttccactgaagccccgcatatagtgtccacgggctccaggtctagagctgctgaccaggcacagttctctgccacaaataacacgcacagaggcaaatacga

SEQ ID NO: 862 - DNA, 434 bp, Homo sapiens
tccacatagaatgatatgatggatcagtggtggtagtacctttctttttcatcttttctttctggagtatggtcaatggtcagcttcatgggttttccttttctacacaaaatagcccggctgtccccaacactggctacaaccagttcaataccatctcgcaatagggctactgttgcagtagtcccagaggtcagaagagttgctacaagtattatgaaaaaaagagtacaagttagtgacagtcaaatgattggatatggaatttttattacaaaataaaacacaagcatgataaactaatgctggaatatatcattctaatttaactagagctaagcaaataaaatgcaaatgaactatgtaagtaacagcatgcagagaaacaagtatttaattcagtaacaagtctccatgcaaacggaaaggttgct

SEQ ID NO: 863 - DNA, 362 bp, Homo sapiens
ttaggccagaatagtagcatcttattttacctgaaaagtttttttatccttccataaattactcccttttaaaaatcattttggcttcagttaaggcttccaagaaaggtgcagcagagacaatcctacattcactctccgcaggtttatcaagtgtttgcaggtcctttcttaccttaatcctcttagtttcaggttctgctatgacaccactggtcttaaggtccaaatctccaatacttcttgtcattgcaagcctgccatttacgtgaggctgccccaaactattccaagctacaaaaccaccacatttcttgatcctgttaaaagttaaatgacaatggtgtgatatgtagaaaacc

SEQ ID NO: 864 - DNA, 430 bp, Homo sapiens
aaacaaagcacatttccttggcatattaaaattttaacttggggaaataaaaattttataattggaaatattatggaatcaagtgtaaaattcactgcaacactcaaaagctaaaacacaatgcctggactgtcctttccttccttctccttgggacttttcaggcagaagctctgggtcacctgttcagtcaccgcatgggctgcttcgttgggatcatggcactgattgacaaagtcacaaatctcttgactattcaccatgaagttaattccatctgtggtgaggaccaggaagctgtcatcagcatgatgtaactgcaatcagaaccaaatgcctatgattataagctagactctgccttagcacaatctcgctaattcaaagattttacctgttttgctaagcggtcatctgtgtaacagcttgt

SEQ ID NO: 865 - DNA, 416 bp, Homo sapiens
tcgtccactggaggcaaagcttctgctgaatgagaagttgatttcagagttcttatattttccccaggcaccaaaaggcactactactgcagtactgttatcctcagtaccgtactgtattgcctgcaaggtttggcaggaagaaagagaaaaacattggaaatcacagtctatacaaagagaaatcagcctttccttcccttggaaatacgcttcccctagaaagccaaactggtcttatgtgcagttactaacctacttatttcacaatggtttgtgattttcaccctgtattaatgcccacaaggattattaaattgcacacggaataacagatgacccaaaacaaccatattaactatattctgctgtagcaattttggcaacagaaacaccagtggactaaggggcattgg

SEQ ID NO: 866 - DNA, 406 bp, Homo sapiens
aacccatagctgcctaagagtcttaaaaattattaatgtgacactctcatctctcatcaagtgtatccaaaccacttctcatttgctctttccatttaaagactcacagtagcttcactacacatatatttatactgaacatgtacagcggaacataaatatgatgagcatttatgaaaaaactactatctaagtggtttacactgacttgtgcgctgatctagtgagttaggagacctttttgatcttatcagtttcttgacatgctcagtgaaaaactgttgcacagaaactctaagtcccagctggtaatcaggcccatcgtccactggaggcaaagcttctgctgaatgagaagttgatttcagagttcttatattttccccaggcaccaaaaggcactact

SEQ ID NO: 867 - DNA, 431 bp, Homo sapiens
cacccttaactgtctcccgaggccgggattggccagagcggaagcggagacgcacttcctaggggcgcgtctggcacgcactgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacaggtagggtgtgcacacaggtacagcggcgggcggtgggcgccgggccccggaacgtcaccggggcggggccggcgggcgtgctgacgtcgggcccgggaggggcgcgggggctgctggggcgacgcgcgctggtcggcttcgtggggcttcggacggcctccagcatcctgatgggggctggagtgtc

SEQ ID NO: 868 - DNA, 445 bp, Homo sapiens
aaggaacagagaagggggtttgaatgtgatacttgtgtcatgctgacttttttttttttttttggtcagtaaatttctaagtgatgaagaaaacttgaaactgtttgggaaatgcaacaatccaaatggccatgggcacaattataaaggtgagagaaaaactgatgacatttcagcccttcaataaggatgaaagagtattcagcaaatgtagacataaagaatgggaaaacttacggacacagtgtgaatgctttgagccttgaatgagaaattaaatgggagttcagaatgaaaggatctgttgtcttggttgggtgtgtgttaagttttaccttgcaatgtcaactcttacaaacagtccaaaacaatgaatggtttaaagcatttttctttgtcctagagtacacaacaagtttctttctgattaggtatggccaaggct

SEQ ID NO: 869 - DNA, 425 bp, Homo sapiens
acaggcagagactgagcagcatcttgatgctccctagtgcattaacataagcagaatttacacccttttcagccttggccgagtgcctctgcttagccaacattcctactaagctcctttgtctcgattgtgtcttgctttggttgctaaaaaaaaaatcttaactaaaataacagatgttttggggtaaatatttaagtatagcttttggggacagatctaataatttatgttgccaacttgtgcttgtatgttgctaacttgtgcttggatgttgatctgttgaaagtcatgctgttttttttgtattttgttttctttccatagttgtggtgacagtacatggagaggtatgtgcagaaaatatttgtgtggtttttgcagattgctgggctctctttcagccagtgtggtggattctgtgt

SEQ ID NO: 870 - DNA, 429 bp, Homo sapiens
tgccaacttgtgcttgtatgttgctaacttgtgcttggatgttgatctgttgaaagtcatgctgttttttttgtattttgttttctttccatagttgtggtgacagtacatggagaggtatgtgcagaaaatatttgtgtggtttttgcagattgctgggctctctttcagccagtgtggtggattctgtgttgaaaactgttccagtcagtattgcttcattgttggcccttgtatatgtgtgtgtggtgagctgccgccattccaggcctctcctctaccaaagtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgc

SEQ ID NO: 871 - DNA, 405 bp, Homo sapiens
tatgtgtgtgtggtgagctgccgccattccaggcctctcctctaccaaagtgttgtctttaatatgctgtatgtggacaggtagaagggctatacaatgaaaaggatgcttgaagtacatggtgcttccatgctgaggtcaatgattatctctgggatgaaggcaaatgtgcaaatgtgggcacagtctctgcacattgtactgcctttaataatttgccagccgtttaatatggagagcctatcacagtaatattcacctttgtttattctttagattgaccctgctacgggaatggttatgaatctggctgatctcaaaaaatatatggaggtaatggcatgttgggtgcttattatgtgctattccctaactgtaatatttggtggccccctatctacctcc

SEQ ID NO: 872 - DNA, 410 bp, Homo sapiens
aggtgaggtttagaggcataagtggaacaatttggaatttgagtcgtaaatggagtcaatgatattttcccttggttttgtctctaggaggcgattatgcagccccttgatcataagaatctggatatggatgtgccatactttgcagatgtggtgaggtgggtggcactgtatcttgccttatgtggattgtaaaacaagaattgatttgaatactttgattgttgtgtgatttctgaagttttaatttaatgaaatctttcgaaactagaatttctattttctgtaaatattaaacatgaaattttattgtttgcattttgaattttttttgtttttgtttttttttcttatagcacgactgaaaatgtagctgtttatatctgggacaacctccagaaagttcttcc

SEQ ID NO: 873 - DNA, 450 bp, Homo sapiens
gaaattttattgtttgcattttgaattttttttgtttttgtttttttttcttatagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtggga

SEQ ID NO: 874 - DNA, 446 bp, Homo sapiens
agccactttgcggatcaccatctatgtttatcattatatgctgttatttcattcagcacttgcctgttacattgtaggcactcagtaatgttgaattgaaaagtggaaggcccatgagcagatcagttgctgtggaacaagggggttgaagttaaggtttgtttgtgctaatttgtatggtacaatcttctaattagggaatatgccatggtttgtgacgtatacgtaagtaataaaatcaacatgatttctgactctccctttggtgagctaaagtaataaattgggaaacttttcaaagatcagtacaaataataaatataaggaacagagaagggggtttgaatgtgatacttgtgtcatgctgacttttttttttttttttggtcagtaaatttctaagtgatgaagaaaacttgaaactgtttgggaaatgcaacaatcca

SEQ ID NO: 875 - DNA, 426 bp, Homo sapiens
ggcccccaccttcctctagactgccccccgccgggttccacacgaaagcccccggccacccccgcggagacccagcagccccagcccgcagcattacccagttgcgggcccgaaaagcctgcacgcatcgagaacccagagcgcccctgccgccgtacaccagcacccggcgcgcctcgcctgcagccgccgccgccgccatcctgctcctgccagcccggctcccgcagctccgaatgcctcgagccggagcgccgcgccccgccccggccggccaaccccgccaagagggaacgcgcggcggccgcgccccgctccgcgcccgctgctgccgcctagcgcgctgccacgctcggggcgccccgccacccggagggactgtaacttcggccaggccctgcccctgggacggggacatcggcgaag

SEQ ID NO: 876 - DNA, 449 bp, Homo sapiens
tgcctgaatagcacatggcctggggcacaggccatgctgatttcattctgcctctactttaaactcaaactcaatgccccccgtcccctcacgtcctccaggggaagcttcttctttatccgtaaaatggattaagagcattaatcactctctccccgagcaactgtaaagattccgggatatacacaaaaaaacagctggcctgtcacctagtgcaaacccaatccttgtcagctggaaaaagagcagagcagaacaaatgagtgactcaggaaaggactcacacttggatttggcattgcccccggcccatcctccagcaacgcaaagaattgcatccaccttctcttcacccaagagctttccaacctcagcagtcaccttcaacacaagaacaaaaaaatgtataaactgtaaggtaagccaacacaggctagcatctttacgga

SEQ ID NO: 877 - DNA, 384 bp, Homo sapiens
tcatcccatgaaagtgcccagcagccccagcaagcaaggtaagcaaccccactccacagatagggaaataaaggcttaccaggagtcccatccagggcagcctttgcgccagccaaggtcaggaggcctccttccttgagatgcttggtagccagatggctggagatggtcgatgtccatatgctctgcttccacatcaggtcacagttcttaaagagagctgagtgaaaaaaacatgtgggctcagcattcccaggaaagaaaccaaaaggtgagctcaactcatgcagccccacactcagggaggccctccctcctggtccccaggtccctatctacagcaaggtctaacacaaacagcacagggctcagtggtcagagaca

SEQ ID NO: 878 - DNA, 411 bp, Homo sapiens
caggtcgcctgtggaaagctacagtcagacaaacggtcacctgcagcagtggggcagaggtgggcagcagccagggaaccccaagcacttacgggagcacagcgatggcggctgccccgggcggcatgccgctgttcttcccagccaggctctggcagagctggtgaacagcacccttggccatgccgtacccgatcatacctgggaaatggggagaagatggctcagtgaccactggcggccagggggacagcaaggacatgcaatcttctcttgagatctctattccctaaaaactttataaatagctgcatctggcctcctccttcaggtcagacgccctcaccaacccccatcaaaaaatggcagagagccacgagaaagaggggatgggaacacgtgggttgggaa

SEQ ID NO: 879 - DNA, 423 bp, Homo sapiens
gatacaggtggggaaactgaggcctcagcaggtcaataatgtgctcagcatggccggtggtgagggagcgagccaggattcatgtcggcactacccattctgccactgtgctgcctgtctccaagtccagctactctgagattccgtctgatgtgcaatgcatcctcagagtcccagagacctcccaagaccacccggattgacgatctcagggaacacagacttgtcctctggaccacagcaggcagagaataggggctggaagctgctcagtcatggacatgtctgtaatactcactcaactaggaattctaagggtgtccaggagctgaagtcagcctcaggcattgatttcctgttcatcggggtatccagggtaaccctgcaatggacacagataagcacgtcattcatgtcgctcct

SEQ ID NO: 880 - DNA, 377 bp, Homo sapiens
ggccaccagtctcgcatgtctttacttcacataaatgtattacactgtcctaggagagcaaatgcatattatgtgagagaaaaataggactcattatctcgtaccacaaacaggggttacagaaaacacaaggctggacaaggccacactgagacaggttagtgacttttctggcaggcccctcataggcactgagatgaggcctaaaaatatgctggggtgagttccgtccttccttctgtggttaccacctggattaggcttcctgagctcggtcggtttttccctgtgatccagtcatggaaagttctggaacagaaaataaaagttttttttatattctcaaagcaaaaatctgggcacatgctgaccttcac

SEQ ID NO: 881 - DNA, 450 bp, Homo sapiens
cccgggcctcaggtgcactcccggcccgccccgcgccctcgcgtcccgccccagctccgccttcgccggcgccgctctgcctgccagcggggcgcgccttgcggcccaggcccgcaaccttccctggtcgtgcgccctatgtaaggccagccgcggcaggaccaaggcggcggtgtcagctcgcgagcctaccctccgcggacggtcttgggtcgcctgctgcctggcttgcctggtcggcggcgggtgccccgcgcgcacgcgcaaagcccgccgcgttccccgaccccaggccgcgctctgtgggcctctgagggcggcatgcgggactacgacgaggtgaccgccttcctgggcgagtgggggcccttccagcgcctcatcttcttcctgctcagcgccagcatcatccccaatggcttcaccggcctgtcctccgtgttcctgata

SEQ ID NO: 882 - DNA, 418 bp, Homo sapiens
cagcgcctcatcttcttcctgctcagcgccagcatcatccccaatggcttcaccggcctgtcctccgtgttcctgatagcgaccccggagcaccgctgccgggtgccggacgccgcgaacctgagcagcgcctggcgcaaccacactgtcccactgcggctgcgggacggccgcgaggtgccccacagctgccgccgctaccggctcgccaccatcgccaacttctcggcgcttgggctggagccggggcgcgacgtggacctggggcagctggagcaggagagctgtctggatggctgggagttcagtcaggacgtctacctgtccaccattgtgaccgaggtgggtgccggcccctgctggggctgagaccagggctcggaggacctgtcgcggtccttgaacccgagctcctctc

SEQ ID NO: 883 - DNA, 447 bp, Homo sapiens
aaggtcacaaaaaggacccgggggtcattggcccagggtgggaacccgagcagagcaggtccagatggtgcactctgtgccctggccttagtttcttgctggatgctttggcccgtagagccccagagccctgcttccagaaccactccagtgacgttcatgccaatggcctgaaccccactgagcgagggtgccctgcctcttccacagccctgggctccgctcagatttttaggagcaagcgttagaggccttgctttctccagggtcagcatgtggacagaacacttactctctgcctgtctctcctcctcaaaatggaagcaagacagtggggcctacaatgctatgaaaaacaggatgggaaagaagcctgctctctgccttcctgcccaggtgagccatcacctgactaagtgagttcacactcagagcgtgtggggatgg

SEQ ID NO: 884 - DNA, 444 bp, Homo sapiens
agtgaatgatacaccccctttgctcatcttgcagtggaacctggtgtgtgaggacgactggaaggccccactcacaatctccttgttcttcgtgggtgtgctgttgggctccttcatttcagggcagctgtcagacaggtaaggtgtctgtcttctggagcaccaggggacctcagcactgaggaagaagcgtgtgcctggcccttgatttcagttggtagtattctttcagcgcagggccctgtattttaaagaagaggaagctatgtctgtgatatagactccatgcctagtaagaagagccaacaaatctgactccgtaattcttgctaagtaaagaaacctgagctgtctaagctgaatgtatctgtgacccggttgactaggtaatatgccatgattcacttctgcagtagcctggcttgcctcccctgggtcactgtg

SEQ ID NO: 885 - DNA, 450 bp, Homo sapiens
cagtctcttgcaatcattatcataattgtagcattgctttttaggcaaccctggtacccaggctgtacatttgtcatggggagtggggagggggagaaatagcatgggcactgtgagaccgagactgtccctggcagccagtattctggcaacactgttcacacccacttactggatggatcttgagaaagccccacttggtggagcccattcctgctgcccttttccagctggttatctgtcactctccttttcttcccaggtttggccggaagaatgtgctgttcgtgaccatgggcatgcagacaggcttcagcttcctgcagatcttctcgaagaattttgagatgtttgtcgtgctgtttgtccttgtaggcatgggccagatctccaactatgtggcagcatttgtcctgggtatggccatcaggttggagttgagtacttgat

SEQ ID NO: 886 - DNA, 422 bp, Homo sapiens
ggagacagtcagacaggaggggttcagaacgccatccgctccctagcgccatgaacttagagagagttctcgctgttttcttgtctgtgtattcacaaagataccataaaaaattaataaggaaggaacccaaattaaactgctaactcgacctcccttgttttgaacagggacagaaattcttggcaagtcagttcgtataatattctctacgttaggagtgtgcatattttatgcatttggctacatggtgctgccactgtttgcttacttcatccgagactggcggatgctgctggtggcgctgacgatgccgggggtgctatgcgtggcactctggtggtgagtgtgaccttgtgccccatgtgcccactggcaggatgatttctgtctggccttcactagagggcagcaacaaccca

SEQ ID NO: 887 - DNA, 377 bp, Homo sapiens
tgtgctctacctggtctgtgggtctgctgttggcagggaggcctcactgagattggaccttgtactgccaggttcatccctgagtccccccgatggctcatctctcagggacgatttgaagaggcagaggtgatcatccgcaaggctgccaaagccaatgggattgttgtgccttccactatctttgacccgagtgaggtaagcaccatgtgggtgtgggtgagagggacagactgaccgtgatttgagagcagcagcacccagccctgaagtcctccctgctcacagcagcccagccctctctccgcccaagccccaactgcccattccccccatccccccactccccacccccacacgggccctgttaacactca

SEQ ID NO: 888 - DNA, 413 bp, Homo sapiens
tgtgctctgagtctctgaccacctcttcttcccatacacttatgatgttgttcctgcagttacaagacctaagttccaagaagcagcagtcccacaacattctggatctgcttcgaacctggaatatccggatggtcaccatcatgtccataatgctgtggtatgtaaaagagacctgcctgaggcttccagacaaagcttcttgaagtggccattgggcctcttgtttacagacatgcctcagacaaaattcaaagcctatgtcatcagagagtgaaaaggatatgtcttgtgttagatggaaaaaatgggcatgtcacaattcttaatgggatggaacctcagaaaaggagaatgaaaacaattgtggaggctgttgtgggaaatatggactcttgtggggaatctctcca

SEQ ID NO: 889 - DNA, 450 bp, Homo sapiens
tgtaccacttgggctggggaaaattatcttttgatctatgaagtaagacgcagggttacagttactgctgccttactagtctctgcttaaagatggtttggaatttactgaaataattgcattgtaaaagttgtacaggttgggaaagatgtggatactgcttttccagctttcttctgcactctgtttcaggatgaccatatcagtgggctattttgggctttcgcttgatactcctaacttgcatggggacatctttgtgaactgcttcctttcagcgatggttgaagtcccagcatatgtgttggcctggctgctgctgcaatatttgccccggcgctattccatggccactgccctcttcctgggtggcagtgtccttctcttcatgcagctggtacccccaggtagggaccatgtgcatctatggtttggggtcttcactgagtc

SEQ ID NO: 890 - DNA, 449 bp, Homo sapiens
ggtcccagcctcctttcagcaatcaatttggagggaaatcttggctatagccccttcccccacaataggaagtgatagaaactgactccccaaaaaatttgggaagaaagtatgtttgttttgctctcaatagctgcatgccatgggttggtacctactcctaccctctttcctttgcttctccagacttgtattatttggctacagtcctggtgatggtgggcaagtttggagtcacggctgccttttccatggtctacgtgtacacagccgagctgtatcccacagtggtgagaaacatgggtgtgggagtcagctccacagcatcccgcctgggcagcatcctgtctccctacttcgtttaccttggtaagtcccatgagccaagggcacactagagcaacgggatggaagtactaactggcttgaatgtgagctggaggttgcgt

SEQ ID NO: 891 - DNA, 412 bp, Homo sapiens
tactcctcccctgcatggtggaacactgctgggctctgggcatgcctgtgccagctctgggttctgaaacctgtctagatgccagattctaatctgactgctcagactgtgagagatgtgagaccaagaaggaaagtgatccccttccagagtcctgggagcataaaggggtagatgagagaccaagtctaactgcagccctgggcctgaggctccgtctgctttgccataggtgcctacgaccgcttcctgccctacattctcatgggaagtctgaccatcctgacagccatcctcaccttgtttctcccagagagcttcggtaccccactcccagacaccattgaccagatgctaagagtcaaagggtaagaagacctcctctgtcagtgttgatgcactgggtctgggt

SEQ ID NO: 892 - DNA, 450 bp, Homo sapiens
ttggagactgggaggcatctttttaaaatgtgttactgacatatttttgcttgtttttatagaatgaaacacagaaaaactccaagtcacacaaggatgttaaaagatggtcaagaaaggcccacaatccttaaaagcacagccttctaacatcgcttccagtaagggagaaactgaagaggaaagactgtcttgccagaaatggccagcttgtgcagactccgagtccttcagtgacaaaaggcctttgctgtttgtcctcttgacctgtgtctgacttgctcctggatgggcacccacactcagaggctacatatggccctagagcaccaccttcctctagggacactggggctacctacagacaacttcatctaagtcctaactattacaatgatggactcagcacctccaaagcagttaatttttcactagaaccagtgagatctg

SEQ ID NO: 893 - DNA, 400 bp, Homo sapiens
gcacattgctacagcccaacctcattagtaacctgtctttggaaggcctgatctgtagatagaggaaaatgccacttgtaagtccctgatcacatgcaggtatgggaaaagagttccctttactcttgccctacctcacaggtagaaactgataactggcattgggaaagactagagaagactttgtcctttaacatttcaagatggaaaatcagagaaaagagaataggaataacaaaagtgaaaatttttctctcatccatgactaacctccagcaacagaacccagaccaaacctgtaggccgactctgcaacttgtagaagaactggtcgagctgaatcacctgaggccttctgctttgcatgcacaggaatcagagagcaggaaaacaggtgaca

SEQ ID NO: 894 - DNA, 439 bp, Homo sapiens
gcagtcttgctaattcatgtcaggcactaagatgagaaaccaaacctttgagtgttatttcacctaacaggtattgagcatgtggcactaacctctatacagtccaaagaagccttcatagcgtagcactttcttaaaacagtcaaagctgtttttatacatgagttctcccacaaaagagccagttgatcgttggttctgcattcgagtttttacaagatcgataggatacacagcagtggctccaacagctaaaattaaacaatatcattatctcagaagaaagtaagataggtcagaagaaagaagaaggtagttaaagtcaaggacaagactgagaaaagaaatgtgttttgaattttaaatacagattttaaaacagtactacctttcttatatctttaataaacaattgagggttttcattcaagtatcccct

SEQ ID NO: 895 - DNA, 386 bp, Homo sapiens
gtgtgtggtgagttcccctgctttcaaattagctagcacctctgagaaaacaaacctgctgtttcctataagaatacctgctagattcttgagtatgtacaaaatcccttaataagaagcaccaactcaaaagacttactgtaagttttatggccttctctggggcaactcccaataactgtggcaacagacctaaaaatcaacaaaaagtagaagtatattaaataaattagcattaactaaacaaatcaacagttctacagaggggattaccacttaaaaactgcttaatctctgctgcaattttctgctattacccttaatgagaatatttgaaatggaatgtttaagtactaacttctaacagccgcatcagtcccaagtac

SEQ ID NO: 896 - DNA, 440 bp, Homo sapiens
aggtgccctagtagactctgcccttgtgcaggatctgtggttaaacagaagccttagtccacacctgttgaccatggtagtgatatatatgtgaaacaagtcttttcaatgaagagagcttcaaaaggtacttacgcagcctccagcaagaatttctgctgcaagtgggaccgaaccatctttgtgcataaatttatccctcacaaaatcgttcaccttgaagaaaaatatttatagaagctgatgaaaaatataaagaaagtcattaaacacttataaatatgcatctgtcaatatatgctatttttttctatcagtctattggagtaatcataaattgcacaatttaacagatcttaaaatagtttgagaagtactcttaatagtataatagttttaaaaaatgaaaaatatatatgcatcactgatgtttcaggaga

SEQ ID NO: 897 - DNA, 402 bp, Homo sapiens
tgcagcttgggtagaacatcttctccaggtgtagaaatgcaaaaaaaaatggatttcatgttgaagaatagtttctgcattaggagatgagaaagtaatcaaataaatgactaaaaaaaaaaaaaagttaccttgtagatcccaaaaaaccccaggtcccgcacgacagacagagcactgactcgaggaccagtggtgatttctcctgccacttgcaaacggatcttgacgatttctaaaggatttgtgaaaatcacctgggagcctccagcctaaaaagaacaaaaaagatttaggatcaaagcaaagaaatggtaaggtgggtcaggaagagatgaatgattattctcaaggataaaaatattctatcctcaagagaatgtagtttcagcccttgtccca

SEQ ID NO: 898 - DNA, 423 bp, Homo sapiens
ggcagcaagggtcagggaagtaagagaactccatgggggacactcaccagctatggcaccagctaagagcaggcttcctgggctaacctgcccatcttcatttgcaaaggaagccttcacatgagcatagcacggaaagtagatggccgagaaaggaatgtcccgcagaaagcatgctttggcaccctgcacatttgcaaaggaagaaaaaccacatgaaacacatatcccattgaggagatcaagcttctctggaactcacctcagaacaaaatattcctggagaagaccaaatttgtactcacacattgaaaggggaacagaaaaaaataacccaaattctgcaagtaataaatctaaactttgtttttaaaacaaaaactagttttgttgtgtgctgtgatgggaggagggcagttctca

SEQ ID NO: 899 - DNA, 435 bp, Homo sapiens
acaacagagcattagcagcagccaaaatttagcagcagatttagcatgatacttacactcctccaaaatcaatgtagaaccatcgctgtagcaattcgtaagtcagcaaagttacaccaaactggggtgaggatcgaaatacacgagctttaaaaaaatggagaaatcacagatataattagatattttaaaaatttacctgataccaaagagttagttaagaacacattatttccataccaccagctcccttccacagagcttttggtccttcttcacgcagtatctttctaaagcagtctatcactccgctgtaagtggtttggccagcccgggcagccacctgtaatctcgtcttgataacatcagcaggggtcactaaagatgctgcaggcatacctgcaggagagacacaacaccatctcagtctggtca

SEQ ID NO: 900 - DNA, 446 bp, Homo sapiens
acaaaggtttctgggcagagggccaaataataattatgaataatttcacaatgatctggttaagaaaacacccagaaaatgaatgatttcacatgataaaaaagcctggacttgaatttaaacaagagatggacgtaaaagggatgaagcattgcttcattcccaggagggatgttctttactgcagtacccacaaaaagacagcactatcccagggctgatcttcctatgggcctccaccaatagcctttgaggtagatactgatggcttgaagagaggtaggtaaagtccaaatttgttttcaatccctgcaaatgtagcaactgccagtttgtagcccccaacgtgatcaggattcggggcaggcaggttgatcctggatttaggaactggctctgatcccatgggttttctaaaagaagagaaaacagagtaagaagctgta

SEQ ID NO: 901 - DNA, 439 bp, Homo sapiens
ctctcgcacccccaggctgatccggcaggcgcgctccccccggcctcgggcccgcggttaccttggcggccgccatgattcgccccggttgcgggcgactgcgggacccactgactggctggctggcgtttgggacccgggcggctcacttctagtcccggcggcggcggcggtgggggcggcgatacggccaggcagcgtgcgttcctggcctgcctccccacgccctcccgccggcgcgggtcatgtggatgctgcccgcccattggctgggcccagccttggccgccggggtgcgcgtgatccagcggcctctgccctgcagccggggagggctcagatcctggggcagtggctggacagggacacgtgaccccgctgcgctgtccagcagcggcggcctctgcggcgtgggcagaggtaacttggccgtgtgcaa

SEQ ID NO: 902 - DNA, 441 bp, Homo sapiens
acaacgaaataaagagctgtttgaaaataatatttaaaagttatagaacacaaatcaaacaagaaacaaaatagattcctttatactgaccttcaaaaatattgttctaagctcagctggatctgctctcttggttaaagccacctataaataaacataaaaatgtttatgttattacaacaaagctgagaaatcaagctagccgactaaaggaaaataaatctcagattaaaaattagtgcatttcatttttgtacttaaataccatgttgccccagtgcataaactatgcccccttcccattttaaattagactccttatgcagcttctaaaatgataaaattttatgcaaggaaccagtagcaaaatctcttaatatctaatgttgaatgtatatcatttcttaaaaagaaaaggtgaaacattgcaaacacctgtca

SEQ ID NO: 903 - DNA, 410 bp, Homo sapiens
atggtcctaagagatgggaaggtatacatttaatgacttcctggtcattagagcaaaagaaagctgtttcaaacaaaaagaattaaataaaataattaaaaataaacatacccatctttggtctgatccaccactccacttaaaagttccacagtctttggattaggctggctttctccaaaaatgttcaagtatcgagtgacaaagtcattgggggacatgaaaaattcaccgtttttctcaatgcttgcatactgtttaaaaaaaagaaaaacagtattttatatatttgattttcaacagtatataatcatgagagtgatatgtgaaaaagttgaaaatatccaaacgataaaatatcagatatgatcatgtacgcttcataatgaccattatctcccaacagttca

SEQ ID NO: 904 - DNA, 412 bp, Homo sapiens
agtcatgccacatctccctcaccttaaaactaaatcagagtatcaaaactactaagccagaaacttgtttttttcgaataggaagatgtttgaactggagctccaaaacattgaagtatctttactaaaagggatatactatcttctataaagaatttccatacactttattttgttcctagaaaaaaaaaaaagaaaatgctcacacaagtccacacttacacagacgtgcacagaagcatgcttcttaccaaaagttacttctcctttgccagctttgtcaaacagctgaaaggctaccataaacaaagcatcaggggcacacaggacagattcaaaggcaacaaattcttgaaaagatattaatctgcaacataaaacaaacataaagcaaaagtcagtagcttgtgga

SEQ ID NO: 905 - DNA, 422 bp, Homo sapiens
aggttgtgtgtgtgtgagagacttcttgattttccccccctttattttatttggtgggattcttgaccttgatttcttaactgattccttgagggttcttttatttctgccatagtttgtaatctgtatgtctatttaaaattgaattactttttttaataagaaaaagcgatatccattcaataacagattttatcagaaagaacttcatttactttgttttaatcaacctgtcttttctcttttcagaggatgttaagcaagtttttggacagaccacaattcatcaacatattccatttaactgggattcagaatttgtgcaactacattttggaaaagaaagaaaaagacacctgacatatgcggaatttactcagtttttattggtgggtctagctcttaaaaagttaaaagggtat

SEQ ID NO: 906 - DNA, 448 bp, Homo sapiens
agccaaaacacactctttgtttgagtttagtaatgtatgtgatcacattaaaatgttagtgtttgcaacagaaaaaaaacactacataacttataagaattgtttttataattccttatttactgagttaaaccacttcattagggcaagttacaacttacagctactagacattcttctacaaaaggagtcaagacatgggggcggatggtgaccatgatgtctcggaagtcgatggctgtgactctcccagtcctagcattgtcccgttgcacaaaggcttgctttgcgtgctccagttgtatttcctacaaataaagaaagtaaaatacttaatttatgcttctcatttaataattactacaaatgacagttcattttaaaatcagactgaagaaagagagtttacatcttgatctaacaagccctcatctgcctaatagcacca

SEQ ID NO: 907 - DNA, 381 bp, Homo sapiens
acaccacaatacttgcaggctagaattcagatatattctcactcacccttagtcacttcaacatctttcctggtgccagccagagtgctatagatctttctaatgagttccatgttgttaaggagcgaattaaatccattaaaataggagaaactaacttgatgggatgtggtacctccagcagcctcaaataaattgaaaacaagagagaagaaaaatatacaaaagatttatagatgattcagaagtacatacatctaaaactagtttgaaagtaatcaaaaatgcatgtacaagaagaaatgactataagtatttttcttttgcattaaaaaaaagctataaatgatttttagaagcaactgcaactaatcatgacca

SEQ ID NO: 908 - DNA, 356 bp, Homo sapiens
tcctgattgctgccctcctcctaacctccttttattaagctaattccaaaaaaaaaaaaaaaaaagccaacttacccccttggctcatataaatctgctaactgaaacaagatgtcaacttccatgggtgtaacctgaccaaatttctgagctgccagaacaaactcctctgtatggaagaaaagttaaaagggaaagattcaagaagaaatagccactaaattcagcattaactcaaggcactggaatgagtgaacatcacaaaactttattattatcatcagttgtagaattcaagtcaatccaaataaggtaagaatttttgcagttcttgcatccatttggaaagcgtgtgc

SEQ ID NO: 909 - DNA, 449 bp, Homo sapiens
ggaacagggttggggtatcctgctaaggaaaccccagaatgcaagtttgctcctctttgctcacctgcctctgggcctcagccaagttaaagggcagagttccctcttccagaggagcaatccgttcaatgtctgctaaggtcatacgtctgtaggggaaaaacaaacacaagcaacaaatataccaatttattacaatttacattataaaatttaaaaacatcccttttttcatttctcatatttcagtatagccttcagtttggcttctttttctcctgattgctgccctcctcctaacctccttttattaagctaattccaaaaaaaaaaaaaaaaaagccaacttacccccttggctcatataaatctgctaactgaaacaagatgtcaacttccatgggtgtaacctgaccaaatttctgagctgccagaacaaactcctctgt

SEQ ID NO: 910 - DNA, 443 bp, Homo sapiens
gcagagagctacggttgctgacttcagactacaagttttagtgcctgacccagcagagggtgccatgaggaaagaatgtactaaaaattaactttagaaaaggttagcaaagatttttcaaaggccaaacacttctgccacaaatgacttccattgcagaacaaaccataagcaatgacgaatttaacaggcatgacttaacaggcagtaaggtcagaaacatttacccttccacctctggaatggttcgcctgtctaggaaaagccgaggtgccctagtagactctgcccttgtgcaggatctgtggttaaacagaagccttagtccacacctgttgaccatggtagtgatatatatgtgaaacaagtcttttcaatgaagagagcttcaaaaggtacttacgcagcctccagcaagaatttctgctgcaagtgggaccgaa

SEQ ID NO: 911 - DNA, 447 bp, Homo sapiens
ctcctccccaaagcctgcgacccagcctcccgcaccttgaccgtgtccagagggtgaccgacgaacaccaggcacacgccgccaaagccgccggccagcaggttcttgagcgggctgatgggttttggctggtcggccatggtcagtccgtctgtcactccgtctgtcagttctcgggccgtcctggcttctcagccccagctgcagtgccggcgccgccgacctttcacccacttttgggtgggcggggcacgagcccggggcaggtcgggaggagggcccagttggcacggtagggcttccgcccggggctgcttccggcctcggccccgcttcgatgggcgtggcagagcgcaaagccgcatgggcggggtttgggagtgtgggccagcgggcctattcctccaggaagccttcccagacttccatgtttcctctgagctccca

SEQ ID NO: 912 - DNA, 357 bp, Homo sapiens
tccaaagcagatgacaacaggggggcacagggtggcgtggtgaaggagcggcagctgtgagctagctgtccagcagaaccacacagttaacctactctccttgggggtaacaaatcaaccccgtgaatgtgttctgagtaagaggaatgcccagcaccatataccaacctctctaaaaagagtcttccggaaacagtcaaaggtcccagagtacatgggaggttgtccaggcaaactcggtggctgtgtctgcagtcggacctgaaaacagaagttaaaatgcagtcacctaccagaatcagaactgcctgtcagcagcaatggcccaactgtctgccaaactgaacagggaaggct

SEQ ID NO: 913 - DNA, 416 bp, Homo sapiens
ccatgtcacgctaccaggcagaacagcaagtgctcctgacctgtaagtactcacctgagcacatcttctgggtgtttctgttgtagtttcttccccaaaccaaacccaaagaagcacacggcaaacatgggagtgaccccgatgataggggcagccattccccgatatagccccgtgatgccctgcaaggaatcacagaagcagaagctgtttacagacaccaccaccttttaaatcactgaaagaggaaagcagtgtgtcctccaaactgtggcttccttcacctcttcttgaagcaaggagaactttaaatggaagaaaatctcccacatttatcagaaataattttcctattatgctggagaaactgaaggcagtttccattctcaaaggcaatctgtttttgttttgggggc

SEQ ID NO: 914 - DNA, 401 bp, Homo sapiens
gggtgaaaggacataaacatgcacacgaaattataaactgaaaggaaaaagctatttcccctccaatcacaaccttacctgtaataagcacttgatccgttctccaggagtcatgattcctgtggtgaatacgccagataacatcccagctgcaaaaagctggggatagctgcattgaaaacaaaaagcagaagcaagcacctgtgactaaccaccgaggacagaggccaatcccagcaaagaggacagttttgtaagaaaaaaaataagtacttggactgggtagaagcctagccacaaatgaatcagatttcgcacaaaaactcagttctaggtatattttaatgtcaaatttcccagagcaagggtctcagtggcaagagcaatgggagtctggccac

SEQ ID NO: 915 - DNA, 387 bp, Homo sapiens
tgacatgcatggtgccaaggctaatctggcaatccaggcaagaccttctgcagcagacccacctcaggtgacctccccaggtgacctcaagtggaggcctgaaaggttacctcgcataagggtaagcacagtccctttgtagatgcctcggatcccaaactcctggtacagcttctttgcacagtccaaggtaccagtgtacttgctttctcctgaagaagcctgaatctgggagggaggagaggatcattaagtcagaaacatcagagtcacagacccagcaggttacaggagactacaaagtaagtatggccattatgtgttacagcaataaaagacttcactgtcaaattgataagtatctggaatgtgtgatcttggggcagg

SEQ ID NO: 916 - DNA, 357 bp, Homo sapiens
ctggacctcagcagccacaagaggaaagcagacatggagccaggaacaacaactacttctgctttcagattcacccacaggagagggcaacgcacccatgactggggaaagtggcttccaagttatgttttcctcacctctttccctccggagtgaagatatttttcagccattcatatgtcatgaaatacattccactagctgggacatctgttagtggcaagaaaaaggtgaattaaagtacataaactcttcgccaggcatggtggtacacacctgtaatctcagcaatttaggagattgaggcagggggattgcttgaggccaggaggtccgcgcttggcctgaattattagt

SEQ ID NO: 917 - DNA, 445 bp, Homo sapiens
ttggtcaggcagatgctaggtgctgccatggagagtgagtatccctagggccttatgagctttgcaccccaggattagccagtgctggggacccactctccccctgtccaccccactaccttccactcaccagtctggaatcgagacttgagcacatctggggggattgccacagcccagttgaagatccctgcaatgcccccagccaccaagatccgaggggcactgagctcactgaccctgtataacaccaaccacagccccagttagacaaaggctgtgagagtggcattcagactatcctgcctgtggcagacagggcagttacagacaggcagaaactggttggagggaggaggtataaggccagtgctgctggcactccttggagaaggtttcatgcacctgtttcaaatatttgctccactggctgaggcacagagta

SEQ ID NO: 918 - DNA, 424 bp, Homo sapiens
cccctcacctcagagatccccaaaggcaaatcctcctgacagcttcaaggaagggagcaaataaggaatgctctggctgaagatagggctttgggaaaactgagaccccagtcctatcccaggaacaagcaaaagtcaaaccacatgcaccctgccctgagccccagagggaaagcacagccctgccagctactcaccgcattggctgggaaggctcggatcatcactgcattgaaccctttgtacaaggatgtgactccttcatcccggatcagctccctcagcacatctctgaaaccattaggatatttcccaggaggtgctgtggggcagaacccaatttttaaggcttcaggaaggagaaactagcagttaagtcttcctgaagggtcaggactagcacagggaaaggacaccttgcagg

SEQ ID NO: 919 - DNA, 433 bp, Homo sapiens
tgccacaggtagtatctggtctggaagctacttgttccatttccaaatccttttaagatcccttaaattgataagaatgaattcaagtttcaaaatgacacactaagttatacacggtgcaggatgtcattaaggcaacagtctcaccaagtccatgcacagggctcggatctcaccattcccctccccttgccctccaagactgcttagttctgcttactactccttctcctcaacgacagcttccagcatccagaagtgaacttgagcagccttcagcctcacaagttgggggtggcccaattaaggaacttcatggcaacttcaaagccaaggaaacaggcctaagaagggattgggaggaagaaaaaagccagcaggaataactattcatagactattcaaagcactatgctttgctggccctgtcagg

SEQ ID NO: 920 - DNA, 450 bp, Homo sapiens
tgggaggaaaacacaaaaggagccaagaggttattctcccatgttcagtactcagactcacccccaactgccatcttctccaaccagcctgtgaacatgagagtagaggaggacaatgacagcccctcagtagtgtccccaactcaccaatggacagggaaatcatggttttgtttggatttggtttcaccttcatgttgtccacaatggctcggatggggttgaaagttttcttggccatgtctgagggcctcacagaccacctggcctttctgcctttcatttttcccggcacagagcttctcccaccaacgttgacatgcacgtccagaattgaggggaggttgcctttgctgctcatctgaatcatgtatgggtccatcactagcgaagcctgcgaggggaaagaagttccctgtgatgttgataacatagcgctgggggacagag

SEQ ID NO: 921 - DNA, 442 bp, Homo sapiens
ttgggagcctagaggggaagtgcccatatgtcaaagaaagccaggaaagaagttggaccttgatgccttgtatttaagcatcccgagacccggttcccaaatccaaaggaccatgtaatcttagcctctccttaggaattgtgcatcaggaaagtgaagaggattgctagacatttagtcctgttataagagcactaaagatttggcagtcaccaggtatggagtctcaggaggagcttaccgatggatggggcatagccattatatttgcccgagtccagggcatctttcattgcctgggtaacttcagggtctgtaggcaggtttccaaacacagtagggtcccctttttatgggaggaaaacacaaaaggagccaagaggttattctcccatgttcagtactcagactcacccccaactgccatcttctccaaccagcc

SEQ ID NO: 922 - DNA, 397 bp, Homo sapiens
ggcctccttgagacagacaccacattaagttgtatgggatggtcattatcacactgtaatgacattaactataatcactgattagtgaccccaactatatgagaagtcttctaattgctaaagggaaattgttctcagcttttccccctctgacacccgtacttcttgtggaacagaaacaagtaaaaagggatagtttgccctaaattgcttcagagctggtgtcttgtataaggctcaccttagcttctaggggtgcctcaggacagtggtaataagaagcaatctcctcccgactggataggaagcctgaaagaaaagagtggaaagtggagcttttttggtttttagagactgtgtctcactctgtcacccggacttggagtgcagtgacaca

SEQ ID NO: 923 - DNA, 359 bp, Homo sapiens
tgtctctggcttcaaccaccactttgagaccttcctctgctgaagtaatgttcatatattttttacaggttagtaactgagcatttgagtctaagattaaaaagtcatttaccaacaaattgtagagtttgacctcaattcccatagactcagccagagtcttgtagagagagaaaccaggtcttggaaccaggatgttttgccctgggttggccaacacagctaaacaaaggtcaatagcttggctgcagccacttgtcagaatgacgtcctgtgaaggaaataaaaggttaatttcattaggggttccaacagcaacaggagaaaagaagttgtcaggtgggtgagttgggagcaat

SEQ ID NO: 924 - DNA, 441 bp, Homo sapiens
aggcctaccactcctatggcacagtattgatgagagacatcagtggagctccccacctccaccccaggcttggaacttagggaatgactggtttttgtcatttcacacaacagctgaaggattctgtccccacctcgtcctctgtgaagtctgctggacgtacctgccagaatcttctgaagatgacgtttgctgaacactgacccacaggggtttgatggattattgacaatgagacaagctgtcttttcatcaattagatattccagttgtttcaggtcaatttcccaagatttctctggctggagagaaagaaaggatgagactaagatgattctgaaacatttagggggaatcctcacttatctcaagggtccaatgtaagcaataaagtctgtctctggcttcaaccaccactttgagaccttcctctgctgaagt

SEQ ID NO: 925 - DNA, 404 bp, Homo sapiens
gtgcagggatgctgatttgctgtaatgaaacgattaggagttgtttctgattattccacttctaaagttcccataaaataatttgagattactgtagtgatatatcctgatcaagactcaccatgtctccatagatctcatcagctaagatggggacacactgccgtgcagccactgaaaataaaacatgctgaaatcagttttaatgtgaattgctttatcatgtaatagtcacataatatcatgtaatttccctatcccgtaatattaagaagttacaattcttaaagagaaagacaaaaagcacaagcaaagtgtgatttgcatttcatgtttgtgtgttttgtcttcctatttaagaactgtaaattcttaacatactcttccagagtgcagagcctgaa

SEQ ID NO: 926 - DNA, 377 bp, Homo sapiens
aaaagcctcccttgtccccactgtgctcatgaaataaatatataccctaaattacacatactctttcaccatattatcacctcattgccaaaaatgtctcttcggtcatgaatgaggatccagcccaacctccagccaggaaccagccagcgcttggccagccctccacaggacaggatggggacatcggtgctgagggtggccagtggttcatatttgcaatccgaaaacacctgagaagaggcacttgttatggttgttttcttgtctacttctcactgcaatcccagatcccgtggctcccacccatttccttctatcactagggacaggtccttggattaatgggatcatccctaccctgaagcatgactggg

SEQ ID NO: 927 - DNA, 378 bp, Homo sapiens
ttcctaattccacgggcggcattctctgactcccaaactcccaaagtggagggcaggagctgcccttaccttgaggaagctcagagtgttgtggtaaaactctcccggggtgcgacataggatgcttttcagagctccctggacaatggtacagggtcccaaaatgcgctgactcagcttcaccagcccatctcggatctaaaagacacccacaagaaacatgttgtttagcttttcttaagcatctctgtcttagagtttcttgttctgacctttctatcaggtttttaatcttggaaagtgatggtgtctagtggcattcttagatcagaccctctgggttcgtagcccagctctgccacacacatgctgcttgac

SEQ ID NO: 928 - DNA, 405 bp, Homo sapiens
tctttgtaccctgcgtgactgcctgtggcaattctgctgaatgactgccctttgccttacaacatgcattgacctagtgcctgccacccacatactcaccatgaggtacatagccccagaagggcggactggccggagtccagggatggcagccaacgccccataacagagatcagcattggactacaagaagaggcaaggagaaatcaaggatcaaaatttaagtaaaagaaaagccaagtcattaaaaatagccccctcattgaagagtgggaacgtaggtgtgatgttctggcataaggagtgaaaaagaaaaagctctattacttgaagcttttcaccaggggcagagagaatggccggaagtgagaaacgtgtgtgtggatgcttacaccgatgccgtct

SEQ ID NO: 929 - DNA, 432 bp, Homo sapiens
ccatgactgggatgctaagtcagcaactgagttcattcatcttaaaatgacttgtgggacaggatcaatttcctctcacctagaacgtttgtttacaacttttcttcccagtatggatgggattatgatgggggggagaagcaaattttaaataggatccatgagacacatcagtttgaatcttatcaaatgagaagacattttgttggaggagaaaagatcaggctaaaaaccagctcagaacttgcttctggggctctagaaactgttgagaatgtcctgagggacacaggcacccaccgttgctgggaggcagtggacagactgctcagcaactaaccgctccgtgaactccacatcgttctcaaattctgggaaatgttccatctcaattccaacctataccaacaggagggagaggccaacttatca

SEQ ID NO: 930 - DNA, 445 bp, Homo sapiens
aggcctagtccagccttccctagatgggacacatcctcaggagaatggatgcaggcctatttatcacactcctcctggctgccttcagcacaatggtagtgctgctcacagaactcctggatccggctgcacgcctccagcatcatcacctcggggactgtgatgaccactcggatgaaattcgggtactcaaagcactgcaaaaagaagagtctgttactttcagagcaattgagtctggtactggaccaccctaaaatggtcaggaccctgatccacaagaagtggtaccatttcatcagggccatcagttcattcagctcccatgactgggatgctaagtcagcaactgagttcattcatcttaaaatgacttgtgggacaggatcaatttcctctcacctagaacgtttgtttacaacttttcttcccagtatggatggga

SEQ ID NO: 931 - DNA, 424 bp, Homo sapiens
gacctcggtccagtcccctgttgcgccgcgcccccgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacttctccttccccgccagagtacatgaaccacctgaccgtgcacaa

SEQ ID NO: 932 - DNA, 415 bp, Homo sapiens
ggaggtgggacttagggtgggggacgccgcggccccgacctagcgggcgagcccggagcgcctgacttctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggc

SEQ ID NO: 933 - DNA, 436 bp, Homo sapiens
atgttggggaggtaggcagtccaggtgcagtgattagtaagatgtggagggtgggggagagggaggagccagggagaactgaatgatctggcctaagggtctgaaagatgccactttgggctgtagggaaatggtagtgctgctgtccctcattccctgagatggggtgaaggaagggcactccctggggatatgggaagttggggcatgaagcctttcctgtcctctagggatcctgaaactccgccacatctggaacctgaagttgatgcgttggtgaggaggaatgggcccctcgaagtgggccgggccggccccacctgcctctgcccagatttgccctcctcctgctctgcccaggaggtggcgtccagcagtccaggcagggcatggggtggggccccgcaggccctcccctgtgcctcccttctgcatg

SEQ ID NO: 934 - DNA, 409 bp, Homo sapiens
ctctgcccagatttgccctcctcctgctctgcccaggaggtggcgtccagcagtccaggcagggcatggggtggggccccgcaggccctcccctgtgcctcccttctgcatgctgatgctgggggcagggtggtggagcggggtgcagggggcaggactaattgcatctgtccctgcttaggacccctgcagctgcagacatctgcttcaccaaggagctacactcccacttcttcagcttgggcaagtgtgtgcctgtgtgccgaggtgagctgctcctccagcgagtgcagggaggcacttctggggcaggaaagctggtggccagtgtctctgttttggagggacctatgggggtaggcatcccgggagccaacatgaggcccagctccatcacatgccagcagag

SEQ ID NO: 935 - DNA, 448 bp, Homo sapiens
gtgagccactgaagatgggggtcataggtagatggaggaattgccaggtcagaatctcggtaggagatgacttgagctgatgctgcctggcacataggggtttagaagatattaggaaggaagccccacagcgtgcccaagtgccatgcaggccctggagacggtcattggagggcgtctgtggatggcgcagtgggggatgggaagtccctaatctgctggggctttcccagcaagcagggactgagggggatagtccccaacacatgggccccagggagaagggcctgtttcattgaggtttggagagtgttgagggtaagctaacctgtcaccccacgcccccgagaatggttactgatagggagaggccttttccttgcaggagatggcgtctaccagaaggggatggacttcattttggagaagctcaaccatggggactggg

SEQ ID NO: 936 - DNA, 434 bp, Homo sapiens
agggagaggccttttccttgcaggagatggcgtctaccagaaggggatggacttcattttggagaagctcaaccatggggactgggtgcatatcttcccagaaggtcagcagggctgactgggtcgagcccccccagtatgagcgggatgggctcccaagcctcgcctctgtgctctctcaccagggaaagtgaacatgagttccgaattcctgcgtttcaagtggggtaagggctgctggtctctggccacagccatcctcccggcccagagatggccctgtgggcccctggctcccgccccctcgggctggcttgtatgggggtagatgggcgtgtttgtagcgccaggaaggggacaggtgctgagactaggcctgcctctcgcaggggcttgcccaagggagctgaattgaactggaggatgtcgggggt

SEQ ID NO: 937 - DNA, 450 bp, Homo sapiens
actaggcctgcctctcgcaggggcttgcccaagggagctgaattgaactggaggatgtcgggggtggcagtggccagaggctggcacagaagcttggctcagggcccagcttatgctaacatttctacctcccccctgggcaggaatcgggcgcctgattgctgagtgtcatctcaaccccatcatcctgcccctgtggcatgtcggtgagcctggggacggggacagagagatggcatctggggtggggggcctgggactccctctggtcccaggctgccctgctccaccccacgtctggccttctgtccactgtgctgcaggaatgaatgacgtccttcctaacagtccgccctacttcccccgctttggacaggtgggtggggactgctgaccttcggctgtctgcctgtctgctgtctgctccgtgtctcccactcagcactatgg

SEQ ID NO: 938 - DNA, 367 bp, Homo sapiens
tgggcactcctactgctcctcatcactcttggcggccaccccacagaaaatcactgtgctgatcgggaagcccttcagtgccctgcctgtactcgagcggctccgggcggagaacaagtcggctgtgagtttcctcctgggtcccccgtagctgtccccggaccccctgctgctggcttccagcagggtgcctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctcc

SEQ ID NO: 939 - DNA, 432 bp, Homo sapiens
ctccaccctctccatcccgtcaccctcccagggcaccctcccagggcaccttggccaagcttcccgaggggtgcaggccatccctggtcctttccctcaggtggagatgcggaaagccctgacggacttcattcaagaggaattccagcatctgaagactcaggcagagcagctccacaaccacctccagcctgggagataggccttgcttgctgccttctggattcttggcccgcacagagctggggctgagggatggactgatgcttttagctcaaacgtggcttttagacagatttgttcatagaccctctcaagtgccctctccgagctggtaggcattccagctcctccgtgcttcctcagttacacaaaggacctcagctgcttctcccacttggccaagcagggaggaagaagcttaggcagggc

SEQ ID NO: 940 - DNA, 23 bp, Homo sapiens
cacctgggttgttagggctcgtg

SEQ ID NO: 941 - DNA, 23 bp, Homo sapiens
tggcaacactgaccctgtcctag

SEQ ID NO: 942 - DNA, 24 bp, Homo sapiens
acctcagcctggttatctctgggt

SEQ ID NO: 943 - DNA, 23 bp, Homo sapiens
agagttcctttggccacttgggt

SEQ ID NO: 944 - DNA, 23 bp, Homo sapiens
ttctcactgtttgtatctctcct

SEQ ID NO: 945 - DNA, 23 bp, Homo sapiens
cagtggtgctggtgagtcagaca

SEQ ID NO: 946 - DNA, 23 bp, Homo sapiens
agttgtgagaagtgtttgtaggt

SEQ ID NO: 947 - DNA, 23 bp, Homo sapiens
tttttgccaggtggggtggaact

SEQ ID NO: 948 - DNA, 23 bp, Homo sapiens
tcccaccactgtcctagccagag

SEQ ID NO: 949 - DNA, 23 bp, Homo sapiens
gcctatgtgggagctctcatcgc

SEQ ID NO: 950 - DNA, 23 bp, Homo sapiens
tgtggaggccctctttgagcttg

SEQ ID NO: 951 - DNA, 23 bp, Homo sapiens
cgtctagtccctgtctccctgca

SEQ ID NO: 952 - DNA, 23 bp, Homo sapiens
ctctgctgctgcccttttcctct

SEQ ID NO: 953 - DNA, 23 bp, Homo sapiens
ctctgaactaggcctggagcagc

SEQ ID NO: 954 - DNA, 20 bp, Homo sapiens
tgaaaaagccccaggaaaaa

SEQ ID NO: 955 - DNA, 23 bp, Homo sapiens
tgctgtgcagatacttggaggca

SEQ ID NO: 956 - DNA, 26 bp, Homo sapiens
tgtactaaagatatttaacctacact

SEQ ID NO: 957 - DNA, 24 bp, Homo sapiens
ccaggactatcagagattgcccgg

SEQ ID NO: 958 - DNA, 24 bp, Homo sapiens
tggtcaaaccagttgctgtactca

SEQ ID NO: 959 - DNA, 24 bp, Homo sapiens
tgtgtagtgaactcttgattagtc

SEQ ID NO: 960 - DNA, 24 bp, Homo sapiens
ggaaatcatcccagtggctgcaga

SEQ ID NO: 961 - DNA, 24 bp, Homo sapiens
tgctcagactacagtgtttgccca

SEQ ID NO: 962 - DNA, 25 bp, Homo sapiens
accatgattcttttcctcagaccca

SEQ ID NO: 963 - DNA, 24 bp, Homo sapiens
tgccacaggtcctacatataacct

SEQ ID NO: 964 - DNA, 23 bp, Homo sapiens
ttgagtggtttctttgattttgt

SEQ ID NO: 965 - DNA, 23 bp, Homo sapiens
gcttgagctggggaagtcgagac

SEQ ID NO: 966 - DNA, 25 bp, Homo sapiens
agcaatcaccatgtgttatttgccg

SEQ ID NO: 967 - DNA, 27 bp, Homo sapiens
tgcagactacagtttgttgatccctgt

SEQ ID NO: 968 - DNA, 23 bp, Homo sapiens
ggtcttctccctcctgagccact

SEQ ID NO: 969 - DNA, 21 bp, Homo sapiens
cagtcgagcgtcggttcctcg

SEQ ID NO: 970 - DNA, 23 bp, Homo sapiens
ctcctgcctcctccttccactca

SEQ ID NO: 971 - DNA, 23 bp, Homo sapiens
ctggggtcacatggcctgagttt

SEQ ID NO: 972 - DNA, 23 bp, Homo sapiens
tctctggagacgtcacaggcctt

SEQ ID NO: 973 - DNA, 23 bp, Homo sapiens
ccagaggggaggagaggaaggtg

SEQ ID NO: 974 - DNA, 23 bp, Homo sapiens
tagggtttcgtgtctgccagcag

SEQ ID NO: 975 - DNA, 23 bp, Homo sapiens
acggacagagccctgcaaaacaa

SEQ ID NO: 976 - DNA, 23 bp, Homo sapiens
aggggcagctctgagaaaaccac

SEQ ID NO: 977 - DNA, 23 bp, Homo sapiens
caagatagccatggtgagcccgg

SEQ ID NO: 978 - DNA, 23 bp, Homo sapiens
cctcctgactgctctccgtcctc

SEQ ID NO: 979 - DNA, 22 bp, Homo sapiens
gaggtgtgggcctggggtttac

SEQ ID NO: 980 - DNA, 23 bp, Homo sapiens
gcaggactttgaggttgaggtgc

SEQ ID NO: 981 - DNA, 23 bp, Homo sapiens
ccccttggaggatttcgacgtgt

SEQ ID NO: 982 - DNA, 23 bp, Homo sapiens
tggagaatgggactgaagagaca

SEQ ID NO: 983 - DNA, 23 bp, Homo sapiens
tagcaagcgcagaggtgatgttt

SEQ ID NO: 984 - DNA, 23 bp, Homo sapiens
ggggcctgtttgtctctcttggg

SEQ ID NO: 985 - DNA, 23 bp, Homo sapiens
tgtgagggccagtatttcccgtg

SEQ ID NO: 986 - DNA, 23 bp, Homo sapiens
tgcgctaggttaagtttccttat

SEQ ID NO: 987 - DNA, 23 bp, Homo sapiens
ttgcttgtgtttttgcaccatct

SEQ ID NO: 988 - DNA, 23 bp, Homo sapiens
tgttcatgcaagaaatttcccca

SEQ ID NO: 989 - DNA, 23 bp, Homo sapiens
agcagctaaagatttgatttaca

SEQ ID NO: 990 - DNA, 25 bp, Homo sapiens
agctgctctcgtttcataatgccca

SEQ ID NO: 991 - DNA, 23 bp, Homo sapiens
tctgtgagagggctagcacacga

SEQ ID NO: 992 - DNA, 23 bp, Homo sapiens
aacacacacctcaccacctcagc

SEQ ID NO: 993 - DNA, 23 bp, Homo sapiens
cccaccttcccacatacaccagc

SEQ ID NO: 994 - DNA, 23 bp, Homo sapiens
ggggtgccttggcagagttaact

SEQ ID NO: 995 - DNA, 23 bp, Homo sapiens
gagacgagggacgcttggagatc

SEQ ID NO: 996 - DNA, 23 bp, Homo sapiens
gtgtgtgacaagagggacggtgg

SEQ ID NO: 997 - DNA, 23 bp, Homo sapiens
ctccccttgacacagcggaagtc

SEQ ID NO: 998 - DNA, 23 bp, Homo sapiens
accctctgcagtgctcaacgaag

SEQ ID NO: 999 - DNA, 23 bp, Homo sapiens
gccctttgcacaccccacttctt

SEQ ID NO: 1000 - DNA, 23 bp, Homo sapiens
gccgaggggactttgaagctcat

SEQ ID NO: 1001 - DNA, 23 bp, Homo sapiens
ccttctcctccgcccaattccag

SEQ ID NO: 1002 - DNA, 23 bp, Homo sapiens
tggtgcataaggagcgaaggagc

SEQ ID NO: 1003 - DNA, 23 bp, Homo sapiens
gaagtctcactgtcccccttgcc

SEQ ID NO: 1004 - DNA, 23 bp, Homo sapiens
agtcagctcagcttctgcgaaga

SEQ ID NO: 1005 - DNA, 23 bp, Homo sapiens
gggagtccagtttgggtgctcag

SEQ ID NO: 1006 - DNA, 24 bp, Homo sapiens
ccctcttcccccataggacaaagg

SEQ ID NO: 1007 - DNA, 23 bp, Homo sapiens
ctgtggtggaggccaagctgata

SEQ ID NO: 1008 - DNA, 24 bp, Homo sapiens
tccagtgccatcatgcatgtttgt

SEQ ID NO: 1009 - DNA, 23 bp, Homo sapiens
gcagatgcagcgaagaggctcaa

SEQ ID NO: 1010 - DNA, 26 bp, Homo sapiens
acctcagcactattgacttttgcact

SEQ ID NO: 1011 - DNA, 23 bp, Homo sapiens
atgggctaaacttggcttgtgca

SEQ ID NO: 1012 - DNA, 24 bp, Homo sapiens
tagagatccttccatctgaaacca

SEQ ID NO: 1013 - DNA, 24 bp, Homo sapiens
acccttcctgaaacaagtcctcca

SEQ ID NO: 1014 - DNA, 23 bp, Homo sapiens
tcactcgtcaacctttcctggcc

SEQ ID NO: 1015 - DNA, 23 bp, Homo sapiens
taaggatgcaggaagaaaccact

SEQ ID NO: 1016 - DNA, 24 bp, Homo sapiens
agcttctgtcctcaaacctcctgt

SEQ ID NO: 1017 - DNA, 26 bp, Homo sapiens
accattcctattgtgtaatgtcacct

SEQ ID NO: 1018 - DNA, 27 bp, Homo sapiens
gttctgcagttgtgtttgagtatcggt

SEQ ID NO: 1019 - DNA, 25 bp, Homo sapiens
gctttctaattagccttgctgatct

SEQ ID NO: 1020 - DNA, 23 bp, Homo sapiens
atgtgatggtggcaggtgggatg

SEQ ID NO: 1021 - DNA, 23 bp, Homo sapiens
aaacactataagttaggcaaagt

SEQ ID NO: 1022 - DNA, 23 bp, Homo sapiens
agggaggcacagactactaggca

SEQ ID NO: 1023 - DNA, 23 bp, Homo sapiens
tctacgcctgtggagccgatact

SEQ ID NO: 1024 - DNA, 18 bp, Homo sapiens
cgaaacctcgcctcaggc

SEQ ID NO: 1025 - DNA, 23 bp, Homo sapiens
ctgtccaggccacttgctgtacc

SEQ ID NO: 1026 - DNA, 23 bp, Homo sapiens
tctgtgcaggcctatcctcaggt

SEQ ID NO: 1027 - DNA, 23 bp, Homo sapiens
ctcaggctgtgcttgtctctgca

SEQ ID NO: 1028 - DNA, 23 bp, Homo sapiens
gctgggtactggggaggtgtttt

SEQ ID NO: 1029 - DNA, 20 bp, Homo sapiens
caggctctgcgggtgtgtcg

SEQ ID NO: 1030 - DNA, 23 bp, Homo sapiens
tccccagggtaagtgagtgaccc

SEQ ID NO: 1031 - DNA, 23 bp, Homo sapiens
gggaaggggtcagagtttgaggc

SEQ ID NO: 1032 - DNA, 23 bp, Homo sapiens
ggagctgccacttttgcaagcaa

SEQ ID NO: 1033 - DNA, 23 bp, Homo sapiens
ggatccgagctcagtgtgtgctt

SEQ ID NO: 1034 - DNA, 23 bp, Homo sapiens
cccttgctatacccacctcccct

SEQ ID NO: 1035 - DNA, 23 bp, Homo sapiens
tgcttagctcagcatggttggct

SEQ ID NO: 1036 - DNA, 23 bp, Homo sapiens
cacgtcgtgaccaccaggaatgt

SEQ ID NO: 1037 - DNA, 23 bp, Homo sapiens
cagactgcgctcttcctgtgtgt

SEQ ID NO: 1038 - DNA, 23 bp, Homo sapiens
ctctgtcgacctggtgtctgcag

SEQ ID NO: 1039 - DNA, 23 bp, Homo sapiens
ccccagcgggtcatgaatatgca

SEQ ID NO: 1040 - DNA, 23 bp, Homo sapiens
gactcacggaactcccacctgtt

SEQ ID NO: 1041 - DNA, 23 bp, Homo sapiens
tgagccatcagtgaccaacagcc

SEQ ID NO: 1042 - DNA, 23 bp, Homo sapiens
gccagagttgttccctggagcag

SEQ ID NO: 1043 - DNA, 23 bp, Homo sapiens
ctgggagttgttcggaggcagag

SEQ ID NO: 1044 - DNA, 23 bp, Homo sapiens
ccttgcctgcccctattgtctcc

SEQ ID NO: 1045 - DNA, 23 bp, Homo sapiens
ccgtagatgacccacagccactg

SEQ ID NO: 1046 - DNA, 23 bp, Homo sapiens
ctcctcatgggcactgttggagg

SEQ ID NO: 1047 - DNA, 23 bp, Homo sapiens
cgcgtgtaggggtcccagaaaat

SEQ ID NO: 1048 - DNA, 23 bp, Homo sapiens
ttccccacccccacttgacctta

SEQ ID NO: 1049 - DNA, 23 bp, Homo sapiens
agaggcctggactacatctcccg

SEQ ID NO: 1050 - DNA, 23 bp, Homo sapiens
cagtgcagtaccgggacagtcac

SEQ ID NO: 1051 - DNA, 22 bp, Homo sapiens
gggttttccagggctgacaccc

SEQ ID NO: 1052 - DNA, 23 bp, Homo sapiens
ttgcacaccctgagtccttcaca

SEQ ID NO: 1053 - DNA, 23 bp, Homo sapiens
tgagactcaagagcaggccctct

SEQ ID NO: 1054 - DNA, 23 bp, Homo sapiens
ccctgctagctctgcaaggtgag

SEQ ID NO: 1055 - DNA, 23 bp, Homo sapiens
gcccttcatgaccagtgctgtga

SEQ ID NO: 1056 - DNA, 23 bp, Homo sapiens
ctggagtagcccaagcaaagggg

SEQ ID NO: 1057 - DNA, 23 bp, Homo sapiens
gtggtgctgatgcgtggcttatg

SEQ ID NO: 1058 - DNA, 23 bp, Homo sapiens
gtgggcagttaaggtggaggctg

SEQ ID NO: 1059 - DNA, 23 bp, Homo sapiens
aattgcaagactgttgactgtca

SEQ ID NO: 1060 - DNA, 24 bp, Homo sapiens
tgaaaagggttcctgctgtgagca

SEQ ID NO: 1061 - DNA, 23 bp, Homo sapiens
tgagatcatcctacacagactga

SEQ ID NO: 1062 - DNA, 23 bp, Homo sapiens
aaccaagtgggagcattgagtga

SEQ ID NO: 1063 - DNA, 23 bp, Homo sapiens
cagcaggactggggcacaaagta

SEQ ID NO: 1064 - DNA, 23 bp, Homo sapiens
taaaaggagacaggcgggcacag

SEQ ID NO: 1065 - DNA, 24 bp, Homo sapiens
acatgtgtgtgcaacagaaaaggt

SEQ ID NO: 1066 - DNA, 24 bp, Homo sapiens
agtgttttccatcggttactacct

SEQ ID NO: 1067 - DNA, 23 bp, Homo sapiens
tgggaaggtctcagcctccttgt

SEQ ID NO: 1068 - DNA, 23 bp, Homo sapiens
ctctgcccttcctttgttggggt

SEQ ID NO: 1069 - DNA, 26 bp, Homo sapiens
acaggccagtaagtgttcatagcaca

SEQ ID NO: 1070 - DNA, 23 bp, Homo sapiens
ggtgcaggcaatggaggcagatc

SEQ ID NO: 1071 - DNA, 23 bp, Homo sapiens
tgtgttcatggccgagaccaagg

SEQ ID NO: 1072 - DNA, 23 bp, Homo sapiens
agggctgatgaggaaaactgccc

SEQ ID NO: 1073 - DNA, 23 bp, Homo sapiens
ggctcctcagggaagcaacacat

SEQ ID NO: 1074 - DNA, 23 bp, Homo sapiens
cctgcagggttccagtgtcacag

SEQ ID NO: 1075 - DNA, 23 bp, Homo sapiens
ggagccctggtcaccatgaatcc

SEQ ID NO: 1076 - DNA, 23 bp, Homo sapiens
gttcaggggtcactcatggcagg

SEQ ID NO: 1077 - DNA, 23 bp, Homo sapiens
ctaacctcctcctgccccctgta

SEQ ID NO: 1078 - DNA, 23 bp, Homo sapiens
ccctgaactgccacctccatctg

SEQ ID NO: 1079 - DNA, 23 bp, Homo sapiens
gatcccttgagtccaggctgcag

SEQ ID NO: 1080 - DNA, 23 bp, Homo sapiens
aggattggaggatggaggcaacg

SEQ ID NO: 1081 - DNA, 23 bp, Homo sapiens
gagcagtagttagctgtggcgct

SEQ ID NO: 1082 - DNA, 23 bp, Homo sapiens
cggcttgtctcctgtcagacgac

SEQ ID NO: 1083 - DNA, 23 bp, Homo sapiens
cctccttacccacaggccctttg

SEQ ID NO: 1084 - DNA, 23 bp, Homo sapiens
gcagtcctcccttcaagcagagg

SEQ ID NO: 1085 - DNA, 23 bp, Homo sapiens
acccagtgtgtgttgttattgtt

SEQ ID NO: 1086 - DNA, 23 bp, Homo sapiens
cagagtgtgcgaggtcagggttc

SEQ ID NO: 1087 - DNA, 23 bp, Homo sapiens
ggatggtgtgaactcagggctcc

SEQ ID NO: 1088 - DNA, 23 bp, Homo sapiens
agaagaagcaccaggtacagcgg

SEQ ID NO: 1089 - DNA, 23 bp, Homo sapiens
actatagtgcgagctctggggct

SEQ ID NO: 1090 - DNA, 23 bp, Homo sapiens
tctcatctggggagactgaggcc

SEQ ID NO: 1091 - DNA, 23 bp, Homo sapiens
cttgctcagtgcttcaggggtcc

SEQ ID NO: 1092 - DNA, 23 bp, Homo sapiens
cagctccacgggtgactatggtg

SEQ ID NO: 1093 - DNA, 23 bp, Homo sapiens
tgcctgacttgttcctctccagc

SEQ ID NO: 1094 - DNA, 23 bp, Homo sapiens
tttaaggcgtttcgggaggaggg

SEQ ID NO: 1095 - DNA, 25 bp, Homo sapiens
ggattgggtgctttggggataaggt

SEQ ID NO: 1096 - DNA, 26 bp, Homo sapiens
agtgcttgataaacttttacagttgt

SEQ ID NO: 1097 - DNA, 18 bp, Homo sapiens
ggccaagccggagcgagg

SEQ ID NO: 1098 - DNA, 23 bp, Homo sapiens
gccttgctcactcaagtgcttgt

SEQ ID NO: 1099 - DNA, 26 bp, Homo sapiens
tggtcattgggaaggaaaactgaggt

SEQ ID NO: 1100 - DNA, 25 bp, Homo sapiens
aggtaaaagggatacaaaagtctgt

SEQ ID NO: 1101 - DNA, 25 bp, Homo sapiens
acagaaaatgttgtgggactctcct

SEQ ID NO: 1102 - DNA, 23 bp, Homo sapiens
acatataaacttctggccctggt

SEQ ID NO: 1103 - DNA, 23 bp, Homo sapiens
gtgcaatggatccagtggtggga

SEQ ID NO: 1104 - DNA, 23 bp, Homo sapiens
cccctacccctaggaaacccctc

SEQ ID NO: 1105 - DNA, 20 bp, Homo sapiens
cagggtcctgcatgggaggc

SEQ ID NO: 1106 - DNA, 23 bp, Homo sapiens
caccactgtcttccccagtcagc

SEQ ID NO: 1107 - DNA, 23 bp, Homo sapiens
aggttgccctcttctttgcctgt

SEQ ID NO: 1108 - DNA, 23 bp, Homo sapiens
ctgatgcaggtggtctcctctgc

SEQ ID NO: 1109 - DNA, 23 bp, Homo sapiens
taaaggcaggaaccccagcatgg

SEQ ID NO: 1110 - DNA, 23 bp, Homo sapiens
tgggtgttcaccagaggttttgt

SEQ ID NO: 1111 - DNA, 20 bp, Homo sapiens
cagtcagtctgaacatcagt

SEQ ID NO: 1112 - DNA, 23 bp, Homo sapiens
tcctttccccttgaagcctggtg

SEQ ID NO: 1113 - DNA, 23 bp, Homo sapiens
acccctaccctccttcctggttc

SEQ ID NO: 1114 - DNA, 23 bp, Homo sapiens
tgacagccaccgtagcatcttcc

SEQ ID NO: 1115 - DNA, 24 bp, Homo sapiens
agatgactgacctgtcgaaagcga

SEQ ID NO: 1116 - DNA, 23 bp, Homo sapiens
tgcgaacatgctgttacctgctt

SEQ ID NO: 1117 - DNA, 23 bp, Homo sapiens
ccgaccaatgtggaagcctcctc

SEQ ID NO: 1118 - DNA, 24 bp, Homo sapiens
aattacttatttctcattgttagt

SEQ ID NO: 1119 - DNA, 26 bp, Homo sapiens
tattttctgtttcctctacctgttct

SEQ ID NO: 1120 - DNA, 23 bp, Homo sapiens
cattgtgccatgccccgtctttc

SEQ ID NO: 1121 - DNA, 25 bp, Homo sapiens
acctgtctttcacaaaagcttaggt

SEQ ID NO: 1122 - DNA, 23 bp, Homo sapiens
tcagcccttcttagcagcgagtt

SEQ ID NO: 1123 - DNA, 23 bp, Homo sapiens
tgtgcagtaatgtcatggagcca

SEQ ID NO: 1124 - DNA, 24 bp, Homo sapiens
tctacatgctttctacgtatttgt

SEQ ID NO: 1125 - DNA, 23 bp, Homo sapiens
cccagaccactcactttgacggg

SEQ ID NO: 1126 - DNA, 23 bp, Homo sapiens
ctgagcctgtcagcatcctcgac

SEQ ID NO: 1127 - DNA, 23 bp, Homo sapiens
atgtaggcgggagggagagtgtt

SEQ ID NO: 1128 - DNA, 23 bp, Homo sapiens
atcattggctgcaaccccaccat

SEQ ID NO: 1129 - DNA, 23 bp, Homo sapiens
cccatgcggctttgtgaattccc

SEQ ID NO: 1130 - DNA, 23 bp, Homo sapiens
ggaagggcacgggattctgagac

SEQ ID NO: 1131 - DNA, 23 bp, Homo sapiens
ctaggggcgtgggtagtcctgac

SEQ ID NO: 1132 - DNA, 22 bp, Homo sapiens
gcagggaaggcttgggtctgag

SEQ ID NO: 1133 - DNA, 23 bp, Homo sapiens
gtgtccgcatcaatggccatgtg

SEQ ID NO: 1134 - DNA, 23 bp, Homo sapiens
tgagccaagcccattgttgttgc

SEQ ID NO: 1135 - DNA, 23 bp, Homo sapiens
caagcctctgaagcctcctgtcc

SEQ ID NO: 1136 - DNA, 23 bp, Homo sapiens
cctcaacagggtccattgcctcc

SEQ ID NO: 1137 - DNA, 23 bp, Homo sapiens
tactgcacctctgacggacagga

SEQ ID NO: 1138 - DNA, 23 bp, Homo sapiens
tccctcaggctttgttccacagg

SEQ ID NO: 1139 - DNA, 23 bp, Homo sapiens
ttcagctgttttccccttgcccc

SEQ ID NO: 1140 - DNA, 23 bp, Homo sapiens
cagcggttcttcctgccatctga

SEQ ID NO: 1141 - DNA, 23 bp, Homo sapiens
aaaacctcatttatttacacctt

SEQ ID NO: 1142 - DNA, 23 bp, Homo sapiens
tgttgtgtacccaactgcctgga

SEQ ID NO: 1143 - DNA, 25 bp, Homo sapiens
cctcccacatttcactctgagatga

SEQ ID NO: 1144 - DNA, 21 bp, Homo sapiens
gctgtcctctgggctggtgac

SEQ ID NO: 1145 - DNA, 23 bp, Homo sapiens
gcagagagcgagcatgagaggac

SEQ ID NO: 1146 - DNA, 23 bp, Homo sapiens
aagaagccctggtaagaccgctc

SEQ ID NO: 1147 - DNA, 23 bp, Homo sapiens
cccgaggacatgtctgacagcag

SEQ ID NO: 1148 - DNA, 23 bp, Homo sapiens
actccacagaaaactcgtggggc

SEQ ID NO: 1149 - DNA, 23 bp, Homo sapiens
gccccaagtctaaccccatctcc

SEQ ID NO: 1150 - DNA, 23 bp, Homo sapiens
tgctcataacagagacggcacgg

SEQ ID NO: 1151 - DNA, 20 bp, Homo sapiens
tgcaaacccactgcctcgtt

SEQ ID NO: 1152 - DNA, 23 bp, Homo sapiens
gctggtgcctgtgtttttgtgca

SEQ ID NO: 1153 - DNA, 23 bp, Homo sapiens
gggtgagcaggaatcaatggggg

SEQ ID NO: 1154 - DNA, 23 bp, Homo sapiens
tgcctcctcctccttgacgtgta

SEQ ID NO: 1155 - DNA, 23 bp, Homo sapiens
agatgagctccgagaaggtgggt

SEQ ID NO: 1156 - DNA, 23 bp, Homo sapiens
gatgtgggggtgactgaggtgtc

SEQ ID NO: 1157 - DNA, 23 bp, Homo sapiens
agggtcctgtctttctgcatcca

SEQ ID NO: 1158 - DNA, 23 bp, Homo sapiens
ctgcctttacttctgagcgccct

SEQ ID NO: 1159 - DNA, 23 bp, Homo sapiens
ccaccatgaggctgttcaccctc

SEQ ID NO: 1160 - DNA, 23 bp, Homo sapiens
aagccccgagtggacacagaaac

SEQ ID NO: 1161 - DNA, 23 bp, Homo sapiens
aagacaatgtctgccagggctgg

SEQ ID NO: 1162 - DNA, 23 bp, Homo sapiens
gtgggtggagaaagccgctagag

SEQ ID NO: 1163 - DNA, 23 bp, Homo sapiens
tggatcatgggccatgtgctttt

SEQ ID NO: 1164 - DNA, 28 bp, Homo sapiens
tatacacttctgcttaggatgataattg

SEQ ID NO: 1165 - DNA, 26 bp, Homo sapiens
tgtgcctttcaaattcagattgagca

SEQ ID NO: 1166 - DNA, 25 bp, Homo sapiens
tgcatgtagtgaactgtttaaggca

SEQ ID NO: 1167 - DNA, 23 bp, Homo sapiens
acaaaatgctaaaatacgagaca

SEQ ID NO: 1168 - DNA, 25 bp, Homo sapiens
tcatgggatgtgattctttcgacca

SEQ ID NO: 1169 - DNA, 24 bp, Homo sapiens
actcaattgcattctgtggggtga

SEQ ID NO: 1170 - DNA, 23 bp, Homo sapiens
aagctgtgttgctccagtagaca

SEQ ID NO: 1171 - DNA, 23 bp, Homo sapiens
tgtgggcatgggaggaataggtg

SEQ ID NO: 1172 - DNA, 23 bp, Homo sapiens
tcagtaagtaactttggctgcca

SEQ ID NO: 1173 - DNA, 27 bp, Homo sapiens
gctaattcttatttgggttctgaatgc

SEQ ID NO: 1174 - DNA, 25 bp, Homo sapiens
acacactttgtccactttgcaatgt

SEQ ID NO: 1175 - DNA, 24 bp, Homo sapiens
agttcccatctctggtagccaagt

SEQ ID NO: 1176 - DNA, 24 bp, Homo sapiens
tccgatttcaaggaaattatttgt

SEQ ID NO: 1177 - DNA, 23 bp, Homo sapiens
aagtcgttcacagaagagagaaa

SEQ ID NO: 1178 - DNA, 24 bp, Homo sapiens
agcccgacaaataaccaagtgaca

SEQ ID NO: 1179 - DNA, 26 bp, Homo sapiens
tggcttctttagttattaacctagca

SEQ ID NO: 1180 - DNA, 24 bp, Homo sapiens
tgagtacaagtatcaaatagcagt

SEQ ID NO: 1181 - DNA, 25 bp, Homo sapiens
cctgttgctccaggtatgttagggt

SEQ ID NO: 1182 - DNA, 23 bp, Homo sapiens
atgtgtcaccatgaagcaggcat

SEQ ID NO: 1183 - DNA, 23 bp, Homo sapiens
tgcaggaactatcacatgtgaga

SEQ ID NO: 1184 - DNA, 23 bp, Homo sapiens
tgtgccagtttctgtccctgctc

SEQ ID NO: 1185 - DNA, 23 bp, Homo sapiens
accgctgaagtttccagttatca

SEQ ID NO: 1186 - DNA, 24 bp, Homo sapiens
gaaactcgttaatttgtagtgttg

SEQ ID NO: 1187 - DNA, 23 bp, Homo sapiens
acatctagcctgaaaacatacca

SEQ ID NO: 1188 - DNA, 23 bp, Homo sapiens
ccatgggcactgtgggtagacac

SEQ ID NO: 1189 - DNA, 25 bp, Homo sapiens
tgaaatattgactttttatggcact

SEQ ID NO: 1190 - DNA, 25 bp, Homo sapiens
gtgacagtcacattagttcagagat

SEQ ID NO: 1191 - DNA, 26 bp, Homo sapiens
aggacaactaaaatatttgcacatgc

SEQ ID NO: 1192 - DNA, 25 bp, Homo sapiens
agtcttgtgttgaaattctcagggt

SEQ ID NO: 1193 - DNA, 23 bp, Homo sapiens
tctgcctagatgctgggaaataa

SEQ ID NO: 1194 - DNA, 23 bp, Homo sapiens
ttagtgtgctcagaaccacgaag

SEQ ID NO: 1195 - DNA, 24 bp, Homo sapiens
ggtggaagtctaccatgataaaca

SEQ ID NO: 1196 - DNA, 24 bp, Homo sapiens
cattagaactgatctattgactga

SEQ ID NO: 1197 - DNA, 23 bp, Homo sapiens
aagatgtagcacaatgagagtat

SEQ ID NO: 1198 - DNA, 25 bp, Homo sapiens
acagagtgtggggaagaaactgtgt

SEQ ID NO: 1199 - DNA, 23 bp, Homo sapiens
agtagttgaatcattcagtgggt

SEQ ID NO: 1200 - DNA, 23 bp, Homo sapiens
gccccgatcaccaaatgcaaaca

SEQ ID NO: 1201 - DNA, 23 bp, Homo sapiens
tgcttggcttcctttcggtggat

SEQ ID NO: 1202 - DNA, 23 bp, Homo sapiens
cctaaagagaggccgcgactgtc

SEQ ID NO: 1203 - DNA, 23 bp, Homo sapiens
tgggccggtaattacgcaaagca

SEQ ID NO: 1204 - DNA, 24 bp, Homo sapiens
cggaacttttcggctctctaaggc

SEQ ID NO: 1205 - DNA, 23 bp, Homo sapiens
aacacacaacaaagcttcctgaa

SEQ ID NO: 1206 - DNA, 23 bp, Homo sapiens
agccacacttgacattcattgtt

SEQ ID NO: 1207 - DNA, 23 bp, Homo sapiens
aaaacttggcattctcagaaggt

SEQ ID NO: 1208 - DNA, 26 bp, Homo sapiens
tgccttatttcccccattttagcagt

SEQ ID NO: 1209 - DNA, 25 bp, Homo sapiens
acctaaaagcttagttaccccatgt

SEQ ID NO: 1210 - DNA, 23 bp, Homo sapiens
attttgtcagaccgtcttcagaa

SEQ ID NO: 1211 - DNA, 23 bp, Homo sapiens
tgttctgccagtgtgctcagctt

SEQ ID NO: 1212 - DNA, 23 bp, Homo sapiens
tcagcactttgaatggcaagcct

SEQ ID NO: 1213 - DNA, 23 bp, Homo sapiens
tgggcaaaacaggaattggggga

SEQ ID NO: 1214 - DNA, 23 bp, Homo sapiens
attctcctgtgacctgtgcctct

SEQ ID NO: 1215 - DNA, 26 bp, Homo sapiens
tgcaatttgtgttacatgcccatgga

SEQ ID NO: 1216 - DNA, 25 bp, Homo sapiens
aggaaagcaactggaaatctgggca

SEQ ID NO: 1217 - DNA, 23 bp, Homo sapiens
agctgaactccctgagtggtaaa

SEQ ID NO: 1218 - DNA, 23 bp, Homo sapiens
cacaccactcaaggcaagcacct

SEQ ID NO: 1219 - DNA, 23 bp, Homo sapiens
gcagcagggaagaggtcgcatag

SEQ ID NO: 1220 - DNA, 23 bp, Homo sapiens
tgcttttagagagctggtggggt

SEQ ID NO: 1221 - DNA, 23 bp, Homo sapiens
tgatttctgcatcttccttttct

SEQ ID NO: 1222 - DNA, 24 bp, Homo sapiens
gcttccttagcctggactgactgg

SEQ ID NO: 1223 - DNA, 23 bp, Homo sapiens
ttagcatctaagtgccagaaagt

SEQ ID NO: 1224 - DNA, 23 bp, Homo sapiens
aagctgggctaccactcgagcta

SEQ ID NO: 1225 - DNA, 23 bp, Homo sapiens
aggcaccttcttattcagccccg

SEQ ID NO: 1226 - DNA, 24 bp, Homo sapiens
tctgcttcctccttagtcccctct

SEQ ID NO: 1227 - DNA, 25 bp, Homo sapiens
tgtcataacatttccccaggtacgt

SEQ ID NO: 1228 - DNA, 23 bp, Homo sapiens
ggaccaaaggggaggatgaggga

SEQ ID NO: 1229 - DNA, 27 bp, Homo sapiens
aggggaatttggcagagagataatcgt

SEQ ID NO: 1230 - DNA, 23 bp, Homo sapiens
agcaaaacaagagctggtcccca

SEQ ID NO: 1231 - DNA, 23 bp, Homo sapiens
ttcaagtcggatgcttggaccca

SEQ ID NO: 1232 - DNA, 23 bp, Homo sapiens
aagatacatctgccctggccagc

SEQ ID NO: 1233 - DNA, 25 bp, Homo sapiens
aggatccttgtagaaccgaagtgga

SEQ ID NO: 1234 - DNA, 23 bp, Homo sapiens
aaagtgcccatgcctctggactg

SEQ ID NO: 1235 - DNA, 23 bp, Homo sapiens
atggcagtcaactcagcatggca

SEQ ID NO: 1236 - DNA, 23 bp, Homo sapiens
atggagggtgctgattcctacca

SEQ ID NO: 1237 - DNA, 25 bp, Homo sapiens
tgttcatcatgtgcattaagccagt

SEQ ID NO: 1238 - DNA, 27 bp, Homo sapiens
ccctgggtcagagaaaagaaagagtgg

SEQ ID NO: 1239 - DNA, 23 bp, Homo sapiens
catcaggcaatggtgtcagccct

SEQ ID NO: 1240 - DNA, 23 bp, Homo sapiens
tttggtctgttgcccatagctgg

SEQ ID NO: 1241 - DNA, 25 bp, Homo sapiens
tggttagtcaagagaaagtctagca

SEQ ID NO: 1242 - DNA, 23 bp, Homo sapiens
accttgggacccataagacctgc

SEQ ID NO: 1243 - DNA, 23 bp, Homo sapiens
actccctccctccttggcctaag

SEQ ID NO: 1244 - DNA, 23 bp, Homo sapiens
ccctttgcagagtcagggtacgg

SEQ ID NO: 1245 - DNA, 23 bp, Homo sapiens
accaggagcaggtgagagtcctt

SEQ ID NO: 1246 - DNA, 23 bp, Homo sapiens
caggctgccaggatataagcgct

SEQ ID NO: 1247 - DNA, 23 bp, Homo sapiens
ggtgctgagcatactggaagcct

SEQ ID NO: 1248 - DNA, 23 bp, Homo sapiens
gggcttctgggtcaggaaaacgt

SEQ ID NO: 1249 - DNA, 23 bp, Homo sapiens
ccctgccgtgcactgaagtactt

SEQ ID NO: 1250 - DNA, 23 bp, Homo sapiens
tgcaacatatgtccttcccacct

SEQ ID NO: 1251 - DNA, 23 bp, Homo sapiens
tatttgctggtatgcccccaccc

SEQ ID NO: 1252 - DNA, 23 bp, Homo sapiens
agcttgaaatgtggggatggcca

SEQ ID NO: 1253 - DNA, 23 bp, Homo sapiens
agcagaggtggcgactgtctttg

SEQ ID NO: 1254 - DNA, 23 bp, Homo sapiens
agtggggtgtggtttctcagtgc

SEQ ID NO: 1255 - DNA, 23 bp, Homo sapiens
tatcttgggctgaccggtgcatg

SEQ ID NO: 1256 - DNA, 23 bp, Homo sapiens
tccctctgactttcccggctgta

SEQ ID NO: 1257 - DNA, 23 bp, Homo sapiens
acattgtgcgcacgggaaaagtg

SEQ ID NO: 1258 - DNA, 24 bp, Homo sapiens
ggcacaagtgaggcaaacataggc

SEQ ID NO: 1259 - DNA, 23 bp, Homo sapiens
acgccgaaatgtctgccaaaagc

SEQ ID NO: 1260 - DNA, 23 bp, Homo sapiens
tctgtgggattttcgttgttggt

SEQ ID NO: 1261 - DNA, 23 bp, Homo sapiens
ccactgctcctggtagcttgtcc

SEQ ID NO: 1262 - DNA, 20 bp, Homo sapiens
ctgtcagtgagcggcccctg

SEQ ID NO: 1263 - DNA, 24 bp, Homo sapiens
acaggaattcttggggcagcttct

SEQ ID NO: 1264 - DNA, 25 bp, Homo sapiens
aggttttagggctatgctgttgggg

SEQ ID NO: 1265 - DNA, 25 bp, Homo sapiens
tgccatttcctttgtctatgcttga

SEQ ID NO: 1266 - DNA, 23 bp, Homo sapiens
tggtatggggcctacctggtcaa

SEQ ID NO: 1267 - DNA, 23 bp, Homo sapiens
cctgaggaaagtggactcggcag

SEQ ID NO: 1268 - DNA, 23 bp, Homo sapiens
actggcatcacagctgctaagga

SEQ ID NO: 1269 - DNA, 24 bp, Homo sapiens
tcctgaggtccttttccatcctga

SEQ ID NO: 1270 - DNA, 23 bp, Homo sapiens
ccactgaactgaaccgcctccag

SEQ ID NO: 1271 - DNA, 25 bp, Homo sapiens
tggagaacttctgtaagctccaggc

SEQ ID NO: 1272 - DNA, 24 bp, Homo sapiens
ggtgctacaatgtcacgcttctcc

SEQ ID NO: 1273 - DNA, 23 bp, Homo sapiens
gttgggtgggaggctcgtttctt

SEQ ID NO: 1274 - DNA, 23 bp, Homo sapiens
agagataagccggtatggttgtt

SEQ ID NO: 1275 - DNA, 24 bp, Homo sapiens
tgcctctgcctgagaacattctct

SEQ ID NO: 1276 - DNA, 27 bp, Homo sapiens
acaccatctgaaagtaaatgctgggct

SEQ ID NO: 1277 - DNA, 23 bp, Homo sapiens
aagtaccaggtaccggcacacac

SEQ ID NO: 1278 - DNA, 23 bp, Homo sapiens
actgtcagttgatcaaattccat

SEQ ID NO: 1279 - DNA, 24 bp, Homo sapiens
tgccactgagtgtcatgatgcagt

SEQ ID NO: 1280 - DNA, 23 bp, Homo sapiens
tcagtgcgctttgaaatcctcgt

SEQ ID NO: 1281 - DNA, 23 bp, Homo sapiens
agagttctctctctccctccttt

SEQ ID NO: 1282 - DNA, 24 bp, Homo sapiens
tggtttctagatggcagtgaaggt

SEQ ID NO: 1283 - DNA, 23 bp, Homo sapiens
ttttgaagagctgcatttgatgt

SEQ ID NO: 1284 - DNA, 23 bp, Homo sapiens
tgtgctttgcgaacaattccctt

SEQ ID NO: 1285 - DNA, 23 bp, Homo sapiens
aaagcttcccctcaacaattgct

SEQ ID NO: 1286 - DNA, 23 bp, Homo sapiens
ttgctgcgtcatttggcaaatca

SEQ ID NO: 1287 - DNA, 24 bp, Homo sapiens
agagcttgttgaacttgtcacgct

SEQ ID NO: 1288 - DNA, 23 bp, Homo sapiens
tcatatcttacataatagggaca

SEQ ID NO: 1289 - DNA, 24 bp, Homo sapiens
tcgggttatttgtttgctcttcca

SEQ ID NO: 1290 - DNA, 23 bp, Homo sapiens
agtctgtgaaaacatagcccgaa

SEQ ID NO: 1291 - DNA, 27 bp, Homo sapiens
agtgctttttgattatttgaagtctgt

SEQ ID NO: 1292 - DNA, 23 bp, Homo sapiens
tgcaccatggtgtagcattacta

SEQ ID NO: 1293 - DNA, 23 bp, Homo sapiens
gctgatggcggcactcaggttat

SEQ ID NO: 1294 - DNA, 23 bp, Homo sapiens
tggagggtcgactgtactaggtt

SEQ ID NO: 1295 - DNA, 24 bp, Homo sapiens
acctcggagcttctcataggaaca

SEQ ID NO: 1296 - DNA, 25 bp, Homo sapiens
tcaacacttgagaaattgctggcct

SEQ ID NO: 1297 - DNA, 23 bp, Homo sapiens
agtcgtgtgtactgctccttggc

SEQ ID NO: 1298 - DNA, 23 bp, Homo sapiens
tggactgcctttttacccaaggt

SEQ ID NO: 1299 - DNA, 23 bp, Homo sapiens
actagctgaataatagagcttga

SEQ ID NO: 1300 - DNA, 25 bp, Homo sapiens
gctaacagcaaacactttggaaagt

SEQ ID NO: 1301 - DNA, 23 bp, Homo sapiens
actgagatgggctagatgtgggt

SEQ ID NO: 1302 - DNA, 23 bp, Homo sapiens
cctgctggctccatggtaaacat

SEQ ID NO: 1303 - DNA, 23 bp, Homo sapiens
tggcctccctgtaatgcttacgg

SEQ ID NO: 1304 - DNA, 23 bp, Homo sapiens
cccggggaatagcctcacctttg

SEQ ID NO: 1305 - DNA, 23 bp, Homo sapiens
ccctgtgacaacattctttacct

SEQ ID NO: 1306 - DNA, 23 bp, Homo sapiens
actggcccttttgctaataagaa

SEQ ID NO: 1307 - DNA, 23 bp, Homo sapiens
tgtgtatccaaaggtgcacacga

SEQ ID NO: 1308 - DNA, 25 bp, Homo sapiens
agttttgttgccttttgctgttgct

SEQ ID NO: 1309 - DNA, 23 bp, Homo sapiens
aggagcactgaaaattcacagta

SEQ ID NO: 1310 - DNA, 23 bp, Homo sapiens
gcttaatatggcagttacataat

SEQ ID NO: 1311 - DNA, 23 bp, Homo sapiens
cttccttccggcctctcgattgg

SEQ ID NO: 1312 - DNA, 23 bp, Homo sapiens
gcaagttcccacagagaccacca

SEQ ID NO: 1313 - DNA, 25 bp, Homo sapiens
tcaagtcagatgtccctggtaccca

SEQ ID NO: 1314 - DNA, 23 bp, Homo sapiens
atagcagccaagtcaagcccctc

SEQ ID NO: 1315 - DNA, 24 bp, Homo sapiens
ccatgcgtgtactcagtagtggca

SEQ ID NO: 1316 - DNA, 23 bp, Homo sapiens
catgggaaggaggtggcaggaag

SEQ ID NO: 1317 - DNA, 23 bp, Homo sapiens
tttcagcctttccctacagctct

SEQ ID NO: 1318 - DNA, 23 bp, Homo sapiens
acacacatttgggcagtttcgca

SEQ ID NO: 1319 - DNA, 23 bp, Homo sapiens
ttttgttaagcatttccctcaaa

SEQ ID NO: 1320 - DNA, 24 bp, Homo sapiens
aggtttctgtggctactctttcct

SEQ ID NO: 1321 - DNA, 23 bp, Homo sapiens
cccgccttctactgcctttcact

SEQ ID NO: 1322 - DNA, 25 bp, Homo sapiens
tccatagttaagcctgacatgagct

SEQ ID NO: 1323 - DNA, 27 bp, Homo sapiens
tgcctaacgatgcatttctcagaaagc

SEQ ID NO: 1324 - DNA, 28 bp, Homo sapiens
tcccagaatttttatttctcccaggagt

SEQ ID NO: 1325 - DNA, 24 bp, Homo sapiens
actaaaaacatttctttttcttct

SEQ ID NO: 1326 - DNA, 27 bp, Homo sapiens
gccaagcaggaatttctaacttagtgc

SEQ ID NO: 1327 - DNA, 26 bp, Homo sapiens
tgttttcatttcccattgtgcgagct

SEQ ID NO: 1328 - DNA, 23 bp, Homo sapiens
tgcactgtctcttctacatctga

SEQ ID NO: 1329 - DNA, 26 bp, Homo sapiens
acctggcaagttttatgcattgtggt

SEQ ID NO: 1330 - DNA, 24 bp, Homo sapiens
acatttggattactgcacatagtg

SEQ ID NO: 1331 - DNA, 21 bp, Homo sapiens
gacctcccagctctgatgtcc

SEQ ID NO: 1332 - DNA, 23 bp, Homo sapiens
taagggactggagagagctggct

SEQ ID NO: 1333 - DNA, 23 bp, Homo sapiens
caggtcttgctgagcatggtcca

SEQ ID NO: 1334 - DNA, 23 bp, Homo sapiens
gcctaggtgttggttccggtgag

SEQ ID NO: 1335 - DNA, 23 bp, Homo sapiens
aagtggctaggaccaggctgact

SEQ ID NO: 1336 - DNA, 23 bp, Homo sapiens
cctgggcttggacaattgtgtgc

SEQ ID NO: 1337 - DNA, 23 bp, Homo sapiens
ggcttcagtgggtggatgtcctc

SEQ ID NO: 1338 - DNA, 23 bp, Homo sapiens
ggcatgtgggttgctgatgggat

SEQ ID NO: 1339 - DNA, 25 bp, Homo sapiens
ccatgtgtatgtggcgactctttgt

SEQ ID NO: 1340 - DNA, 23 bp, Homo sapiens
gccctgcattctcttgccttcct

SEQ ID NO: 1341 - DNA, 23 bp, Homo sapiens
aggcgtccatctgacctctgact

SEQ ID NO: 1342 - DNA, 23 bp, Homo sapiens
gcctttgtaagtcctggctgtgc

SEQ ID NO: 1343 - DNA, 23 bp, Homo sapiens
ccagtgacctctgtgctgtgctt

SEQ ID NO: 1344 - DNA, 23 bp, Homo sapiens
gagctgcctattgatgggagggc

SEQ ID NO: 1345 - DNA, 23 bp, Homo sapiens
gggaggagagactggaggacctg

SEQ ID NO: 1346 - DNA, 23 bp, Homo sapiens
gtgatggtacccagacttgcccc

SEQ ID NO: 1347 - DNA, 23 bp, Homo sapiens
agcaaaaccctgggttccacctc

SEQ ID NO: 1348 - DNA, 23 bp, Homo sapiens
ggtgttcaagaccagcctgctca

SEQ ID NO: 1349 - DNA, 23 bp, Homo sapiens
gtgctcatcacctcagccccatt

SEQ ID NO: 1350 - DNA, 23 bp, Homo sapiens
actacactccagcctgggccata

SEQ ID NO: 1351 - DNA, 23 bp, Homo sapiens
gactccccatccaacacactccc

SEQ ID NO: 1352 - DNA, 23 bp, Homo sapiens
ttcagtgctgcagatggtccagg

SEQ ID NO: 1353 - DNA, 23 bp, Homo sapiens
aggtgatgtggcagcctgttacg

SEQ ID NO: 1354 - DNA, 23 bp, Homo sapiens
gaatccttcaggctttggcacgc

SEQ ID NO: 1355 - DNA, 23 bp, Homo sapiens
gacaccatcgggggcgctgtatc

SEQ ID NO: 1356 - DNA, 23 bp, Homo sapiens
cggaagcctcacgtactgcttgt

SEQ ID NO: 1357 - DNA, 23 bp, Homo sapiens
ggggaaggcttgtagagtggagc

SEQ ID NO: 1358 - DNA, 23 bp, Homo sapiens
ttcagtgcagtggtggtcagctc

SEQ ID NO: 1359 - DNA, 23 bp, Homo sapiens
ccctgtggcatcatggaccagtt

SEQ ID NO: 1360 - DNA, 23 bp, Homo sapiens
ctgctccctgaaggaccaaggtg

SEQ ID NO: 1361 - DNA, 23 bp, Homo sapiens
acgtggcgactacagagcctttg

SEQ ID NO: 1362 - DNA, 22 bp, Homo sapiens
ggtttatggcagccgcatgacg

SEQ ID NO: 1363 - DNA, 20 bp, Homo sapiens
ggctggccaatcatcggggg

SEQ ID NO: 1364 - DNA, 20 bp, Homo sapiens
gagcgggacagggccgagag

SEQ ID NO: 1365 - DNA, 20 bp, Homo sapiens
tcccctagggtgggccttcc

SEQ ID NO: 1366 - DNA, 20 bp, Homo sapiens
ctcagcattggggttcggcc

SEQ ID NO: 1367 - DNA, 23 bp, Homo sapiens
ggacctgcctgttcttctctgct

SEQ ID NO: 1368 - DNA, 23 bp, Homo sapiens
gcctatttgctgaccacactccg

SEQ ID NO: 1369 - DNA, 23 bp, Homo sapiens
tggtgaggcttttcaagtaccta

SEQ ID NO: 1370 - DNA, 19 bp, Homo sapiens
cgctctgccactgtccgga

SEQ ID NO: 1371 - DNA, 23 bp, Homo sapiens
cagcccagcccttatcctcctta

SEQ ID NO: 1372 - DNA, 23 bp, Homo sapiens
tggggactgtggaagtgaagtgc

SEQ ID NO: 1373 - DNA, 23 bp, Homo sapiens
tgaaaactccaaaccgactctgt

SEQ ID NO: 1374 - DNA, 23 bp, Homo sapiens
gcagaggaatgtgcgaggagagg

SEQ ID NO: 1375 - DNA, 24 bp, Homo sapiens
aggggctagcctatctctgtctgg

SEQ ID NO: 1376 - DNA, 23 bp, Homo sapiens
gggactttccggggtgactttcc

SEQ ID NO: 1377 - DNA, 23 bp, Homo sapiens
tgatgagggtccgagaagggagg

SEQ ID NO: 1378 - DNA, 23 bp, Homo sapiens
ctcttgggtcttagctgggcagg

SEQ ID NO: 1379 - DNA, 23 bp, Homo sapiens
gtatcagggaccaggcagccttg

SEQ ID NO: 1380 - DNA, 23 bp, Homo sapiens
agcatggagaccagagcccacta

SEQ ID NO: 1381 - DNA, 23 bp, Homo sapiens
ctgagcatcgaacccagatgcca

SEQ ID NO: 1382 - DNA, 23 bp, Homo sapiens
cccctcgctcttaccctgccatt

SEQ ID NO: 1383 - DNA, 23 bp, Homo sapiens
ccctcttgtccttgatgggctgg

SEQ ID NO: 1384 - DNA, 19 bp, Homo sapiens
ccggccaatgggagcgctc

SEQ ID NO: 1385 - DNA, 22 bp, Homo sapiens
gtccatggagaagggccctgtg

SEQ ID NO: 1386 - DNA, 24 bp, Homo sapiens
tggacatgttactaaagcaagcct

SEQ ID NO: 1387 - DNA, 23 bp, Homo sapiens
aggcactgtattttcactcagct

SEQ ID NO: 1388 - DNA, 27 bp, Homo sapiens
tgaggaaggcttatcaattttacttca

SEQ ID NO: 1389 - DNA, 23 bp, Homo sapiens
ctggagggcttcagggtgttctg

SEQ ID NO: 1390 - DNA, 24 bp, Homo sapiens
accaaaccagcagctgtctactcc

SEQ ID NO: 1391 - DNA, 25 bp, Homo sapiens
gccctctactttcttcttgccacct

SEQ ID NO: 1392 - DNA, 23 bp, Homo sapiens
accaagggaaggtggtggaatgt

SEQ ID NO: 1393 - DNA, 23 bp, Homo sapiens
ttttctaagtatttccagaaaca

SEQ ID NO: 1394 - DNA, 23 bp, Homo sapiens
caaagcactccccaggaccaaca

SEQ ID NO: 1395 - DNA, 23 bp, Homo sapiens
ggagtgtcctgcagccatggaat

SEQ ID NO: 1396 - DNA, 23 bp, Homo sapiens
ccaggcacagttctggccctatc

SEQ ID NO: 1397 - DNA, 23 bp, Homo sapiens
ttggcagtcaggaagcagggatg

SEQ ID NO: 1398 - DNA, 23 bp, Homo sapiens
aagagcaacaaaggggtggccat

SEQ ID NO: 1399 - DNA, 23 bp, Homo sapiens
tgcctggcacatagcttttctca

SEQ ID NO: 1400 - DNA, 23 bp, Homo sapiens
gcgtctggacagtgaccatgtgt

SEQ ID NO: 1401 - DNA, 23 bp, Homo sapiens
ttgctctttctttgcttcctttc

SEQ ID NO: 1402 - DNA, 23 bp, Homo sapiens
aatgaaaggcgaggatttggcca

SEQ ID NO: 1403 - DNA, 23 bp, Homo sapiens
aagcactctgcctatcggatgcc

SEQ ID NO: 1404 - DNA, 23 bp, Homo sapiens
actttgcgcgagtgtcttggttg

SEQ ID NO: 1405 - DNA, 21 bp, Homo sapiens
ggccatgcagtcctgtgccag

SEQ ID NO: 1406 - DNA, 23 bp, Homo sapiens
cggaatctccaccccacttcacg

SEQ ID NO: 1407 - DNA, 23 bp, Homo sapiens
gacactgatggctggtggacctc

SEQ ID NO: 1408 - DNA, 24 bp, Homo sapiens
acaggcttacagggatctgacaga

SEQ ID NO: 1409 - DNA, 23 bp, Homo sapiens
catggcttcttggtcctcgctga

SEQ ID NO: 1410 - DNA, 23 bp, Homo sapiens
actgggtaggccactgaccttca

SEQ ID NO: 1411 - DNA, 23 bp, Homo sapiens
ctttctctgcctgggctcctgtc

SEQ ID NO: 1412 - DNA, 23 bp, Homo sapiens
gcattgccacctcctttgcccta

SEQ ID NO: 1413 - DNA, 23 bp, Homo sapiens
gggggccaaccttgaggagaaat

SEQ ID NO: 1414 - DNA, 25 bp, Homo sapiens
acagcagtcagtttggacaagacct

SEQ ID NO: 1415 - DNA, 24 bp, Homo sapiens
actgtgcttagacttaccctcggt

SEQ ID NO: 1416 - DNA, 23 bp, Homo sapiens
agggcaaaggggagtcagaggat

SEQ ID NO: 1417 - DNA, 23 bp, Homo sapiens
ggatgtgaacacactctgcccgt

SEQ ID NO: 1418 - DNA, 24 bp, Homo sapiens
tgctgaattcacttcaagctggga

SEQ ID NO: 1419 - DNA, 23 bp, Homo sapiens
tccagggtgtcttggatgatggt

SEQ ID NO: 1420 - DNA, 22 bp, Homo sapiens
gctcacctgctattggccaggt

SEQ ID NO: 1421 - DNA, 23 bp, Homo sapiens
actgcctctctctgcctctcctc

SEQ ID NO: 1422 - DNA, 23 bp, Homo sapiens
ggtggctgctactggtaccatcg

SEQ ID NO: 1423 - DNA, 23 bp, Homo sapiens
ggggagagatgggagggagactg

SEQ ID NO: 1424 - DNA, 23 bp, Homo sapiens
gctggcgctgaaaaacattgcga

SEQ ID NO: 1425 - DNA, 23 bp, Homo sapiens
ggtagttgggggagctgaggtca

SEQ ID NO: 1426 - DNA, 24 bp, Homo sapiens
acccagcacttcatcctgagttct

SEQ ID NO: 1427 - DNA, 18 bp, Homo sapiens
gggctccggctgctgaca

SEQ ID NO: 1428 - DNA, 26 bp, Homo sapiens
agcacttcttgttctgtttgtagcct

SEQ ID NO: 1429 - DNA, 23 bp, Homo sapiens
gcgcgtgcgtgttatgttttctt

SEQ ID NO: 1430 - DNA, 23 bp, Homo sapiens
ccagtgagcccggtgaatgttct

SEQ ID NO: 1431 - DNA, 24 bp, Homo sapiens
tgtgtcttctccctcattccccca

SEQ ID NO: 1432 - DNA, 24 bp, Homo sapiens
accgaagttgcttgctgacactct

SEQ ID NO: 1433 - DNA, 23 bp, Homo sapiens
caggatctgtgcagtggggcatc

SEQ ID NO: 1434 - DNA, 23 bp, Homo sapiens
gcctcttggggccaaaggacata

SEQ ID NO: 1435 - DNA, 23 bp, Homo sapiens
ctattccaacgctgagcaagtgc

SEQ ID NO: 1436 - DNA, 23 bp, Homo sapiens
ttctgcagcactgaacccccaaa

SEQ ID NO: 1437 - DNA, 23 bp, Homo sapiens
agttgtgcctgcattagttggtt

SEQ ID NO: 1438 - DNA, 22 bp, Homo sapiens
cacaggtgtgctctggcccatg

SEQ ID NO: 1439 - DNA, 23 bp, Homo sapiens
ttccccgacacaaaaccccctag

SEQ ID NO: 1440 - DNA, 23 bp, Homo sapiens
acccgcattctccgatctgttgg

SEQ ID NO: 1441 - DNA, 23 bp, Homo sapiens
tgtcccactgagtcaaggtggga

SEQ ID NO: 1442 - DNA, 23 bp, Homo sapiens
gagccagtacagggagccctttg

SEQ ID NO: 1443 - DNA, 23 bp, Homo sapiens
aggccagggttctgagaacaaat

SEQ ID NO: 1444 - DNA, 23 bp, Homo sapiens
ggctctggctttcctcccctttt

SEQ ID NO: 1445 - DNA, 25 bp, Homo sapiens
tgcctatggaaaacagttcacccca

SEQ ID NO: 1446 - DNA, 23 bp, Homo sapiens
actggaaaaccaggcactccacc

SEQ ID NO: 1447 - DNA, 24 bp, Homo sapiens
aggtactacagaaattgtttcgca

SEQ ID NO: 1448 - DNA, 23 bp, Homo sapiens
agtgggccaaagctgcctgaata

SEQ ID NO: 1449 - DNA, 28 bp, Homo sapiens
tggagaaatgatgttgctgctattgtgc

SEQ ID NO: 1450 - DNA, 23 bp, Homo sapiens
tgccagcctaaggaatttcagtt

SEQ ID NO: 1451 - DNA, 25 bp, Homo sapiens
agacatttttgcttcagctagaggt

SEQ ID NO: 1452 - DNA, 23 bp, Homo sapiens
tgccacctaccagtctccagtct

SEQ ID NO: 1453 - DNA, 25 bp, Homo sapiens
agcatgtttaaggtagtgcttaggt

SEQ ID NO: 1454 - DNA, 23 bp, Homo sapiens
aaggcttgtggttccatagagtt

SEQ ID NO: 1455 - DNA, 23 bp, Homo sapiens
gagaaagacctccagacaggctg

SEQ ID NO: 1456 - DNA, 23 bp, Homo sapiens
agcttgtccttatccctcactgt

SEQ ID NO: 1457 - DNA, 27 bp, Homo sapiens
agcgtagaggaacatgaataacgaggt

SEQ ID NO: 1458 - DNA, 23 bp, Homo sapiens
agagcctagcttgattctgatct

SEQ ID NO: 1459 - DNA, 26 bp, Homo sapiens
aggtggattcatcaccattcattgct

SEQ ID NO: 1460 - DNA, 23 bp, Homo sapiens
ctgcaatgtgaaaaccatgttgg

SEQ ID NO: 1461 - DNA, 23 bp, Homo sapiens
ccactgcatcaaaatgggccctc

SEQ ID NO: 1462 - DNA, 27 bp, Homo sapiens
gctcacttatggtttacaaactctggc

SEQ ID NO: 1463 - DNA, 28 bp, Homo sapiens
gtcatcagactttatatattttaattag

SEQ ID NO: 1464 - DNA, 24 bp, Homo sapiens
agcaagctcaggaggagttaaggc

SEQ ID NO: 1465 - DNA, 23 bp, Homo sapiens
tcaaggagcgcagtgttttgtgt

SEQ ID NO: 1466 - DNA, 23 bp, Homo sapiens
tgcactagaaaccagccagcagg

SEQ ID NO: 1467 - DNA, 23 bp, Homo sapiens
tgacgtccatatggcaggaatga

SEQ ID NO: 1468 - DNA, 24 bp, Homo sapiens
accggttaacagtgtacctgctcc

SEQ ID NO: 1469 - DNA, 24 bp, Homo sapiens
agtcccagaatgcagagagggtga

SEQ ID NO: 1470 - DNA, 23 bp, Homo sapiens
agttgccacgagtgtctggaact

SEQ ID NO: 1471 - DNA, 23 bp, Homo sapiens
gacagtgctctcagagacccgtg

SEQ ID NO: 1472 - DNA, 23 bp, Homo sapiens
ctcattgcctgtgagtgccctca

SEQ ID NO: 1473 - DNA, 23 bp, Homo sapiens
tgccaaattacgaccatctcatt

SEQ ID NO: 1474 - DNA, 23 bp, Homo sapiens
gtccatgtctggcctaaccggtc

SEQ ID NO: 1475 - DNA, 23 bp, Homo sapiens
atgacgtgtgtctgcgtctgtcc

SEQ ID NO: 1476 - DNA, 23 bp, Homo sapiens
aaagaggagaggacgaggcccat

SEQ ID NO: 1477 - DNA, 25 bp, Homo sapiens
aggacaaggaaggaggaagttgaca

SEQ ID NO: 1478 - DNA, 21 bp, Homo sapiens
gacacctcccagtgaccgcac

SEQ ID NO: 1479 - DNA, 23 bp, Homo sapiens
atcaaaacggagagaggctgggg

SEQ ID NO: 1480 - DNA, 23 bp, Homo sapiens
tgcttgttcctgttactaagtga

SEQ ID NO: 1481 - DNA, 24 bp, Homo sapiens
aggccatcacacattgctctcagt

SEQ ID NO: 1482 - DNA, 18 bp, Homo sapiens
acttggcaatgtctccct

SEQ ID NO: 1483 - DNA, 22 bp, Homo sapiens
gtgctgaaaggagttcacctgg

SEQ ID NO: 1484 - DNA, 23 bp, Homo sapiens
ggacactgacctcattcctcccc

SEQ ID NO: 1485 - DNA, 23 bp, Homo sapiens
ccccttacgcctcagtctcctga

SEQ ID NO: 1486 - DNA, 23 bp, Homo sapiens
ccctggtgttgagggcataccat

SEQ ID NO: 1487 - DNA, 23 bp, Homo sapiens
aaacctgcagttccaccgcttct

SEQ ID NO: 1488 - DNA, 23 bp, Homo sapiens
cggggcccatgacagagaagaaa

SEQ ID NO: 1489 - DNA, 23 bp, Homo sapiens
ttccaaggatctcaccgtgccag

SEQ ID NO: 1490 - DNA, 23 bp, Homo sapiens
gcacactcggttttctgggtcct

SEQ ID NO: 1491 - DNA, 23 bp, Homo sapiens
cccaggcctctagtcccagtagg

SEQ ID NO: 1492 - DNA, 23 bp, Homo sapiens
ggacatcactccacccgcacttt

SEQ ID NO: 1493 - DNA, 23 bp, Homo sapiens
cctccagcagggtctgtgattgg

SEQ ID NO: 1494 - DNA, 23 bp, Homo sapiens
aggagctagaacccaggtccagg

SEQ ID NO: 1495 - DNA, 23 bp, Homo sapiens
catggctctgtgggtgggatctg

SEQ ID NO: 1496 - DNA, 23 bp, Homo sapiens
ttgggggtaatggctgaagctgg

SEQ ID NO: 1497 - DNA, 23 bp, Homo sapiens
tcttcatctagttgacctactga

SEQ ID NO: 1498 - DNA, 23 bp, Homo sapiens
tgtccggcccattagtaaatgct

SEQ ID NO: 1499 - DNA, 23 bp, Homo sapiens
cctggaggcgctcagagcatatg

SEQ ID NO: 1500 - DNA, 23 bp, Homo sapiens
ggactttggggccagtctccaaa

SEQ ID NO: 1501 - DNA, 23 bp, Homo sapiens
ccaaaggactagcgtaccaggcc

SEQ ID NO: 1502 - DNA, 23 bp, Homo sapiens
agcagcacacctagtttacccgc

SEQ ID NO: 1503 - DNA, 23 bp, Homo sapiens
ggaagagtgggtgctgggagatg

SEQ ID NO: 1504 - DNA, 23 bp, Homo sapiens
tatctggctgtggaggaccccaa

SEQ ID NO: 1505 - DNA, 23 bp, Homo sapiens
gaatgaaccagaccagggaggcc

SEQ ID NO: 1506 - DNA, 25 bp, Homo sapiens
gcaagggtgagtctctgaatttggc

SEQ ID NO: 1507 - DNA, 23 bp, Homo sapiens
cctcttggccctgctctctcctg

SEQ ID NO: 1508 - DNA, 23 bp, Homo sapiens
agtaaatggtgccttgggagcca

SEQ ID NO: 1509 - DNA, 23 bp, Homo sapiens
tccctttgtgcccagttgatgca

SEQ ID NO: 1510 - DNA, 23 bp, Homo sapiens
acacccctccctcttgctacctt

SEQ ID NO: 1511 - DNA, 24 bp, Homo sapiens
actttcagtctcttttctggggga

SEQ ID NO: 1512 - DNA, 24 bp, Homo sapiens
tcttaacatcctgccaacttgcct

SEQ ID NO: 1513 - DNA, 23 bp, Homo sapiens
gaggtcccaagcaacccaaacct

SEQ ID NO: 1514 - DNA, 23 bp, Homo sapiens
tggggttgtggacagcgctaaaa

SEQ ID NO: 1515 - DNA, 21 bp, Homo sapiens
cgcctagggtgattggctgct

SEQ ID NO: 1516 - DNA, 23 bp, Homo sapiens
ctccttcctgcctggtccccatc

SEQ ID NO: 1517 - DNA, 23 bp, Homo sapiens
tgggtagtggagatgctgtctgc

SEQ ID NO: 1518 - DNA, 23 bp, Homo sapiens
gaacctgcgagtgagttgggagg

SEQ ID NO: 1519 - DNA, 23 bp, Homo sapiens
tacaaggtgcttcccttctgccg

SEQ ID NO: 1520 - DNA, 23 bp, Homo sapiens
gaggcagtaccagtgagctgctc

SEQ ID NO: 1521 - DNA, 23 bp, Homo sapiens
aggtctatggcctggctgagaca

SEQ ID NO: 1522 - DNA, 23 bp, Homo sapiens
caagctagtggcagaggaggctg

SEQ ID NO: 1523 - DNA, 23 bp, Homo sapiens
aagggagtccagagagggaaggg

SEQ ID NO: 1524 - DNA, 25 bp, Homo sapiens
agtgaagacttttcaaatgctttgt

SEQ ID NO: 1525 - DNA, 25 bp, Homo sapiens
actcaaagaatggctaaaacgtcca

SEQ ID NO: 1526 - DNA, 24 bp, Homo sapiens
actgtaaacatttgccggatgaga

SEQ ID NO: 1527 - DNA, 23 bp, Homo sapiens
attgctgaaattttgtcactctt

SEQ ID NO: 1528 - DNA, 25 bp, Homo sapiens
agccatgttgttcaacacaggacct

SEQ ID NO: 1529 - DNA, 23 bp, Homo sapiens
agatctggattgcattggtggca

SEQ ID NO: 1530 - DNA, 26 bp, Homo sapiens
aggccatttgtatcatagtactgtca

SEQ ID NO: 1531 - DNA, 23 bp, Homo sapiens
atctcagcttgcagggaagccag

SEQ ID NO: 1532 - DNA, 28 bp, Homo sapiens
tgtgaaaccattaacgtttgcactgtgt

SEQ ID NO: 1533 - DNA, 25 bp, Homo sapiens
agggatagtgggctttccttacaca

SEQ ID NO: 1534 - DNA, 24 bp, Homo sapiens
tgtttccctgagatcattctccct

SEQ ID NO: 1535 - DNA, 24 bp, Homo sapiens
gctgccacaattgttcttgaccca

SEQ ID NO: 1536 - DNA, 26 bp, Homo sapiens
tgtgaaggtactgttaaagtgttgca

SEQ ID NO: 1537 - DNA, 23 bp, Homo sapiens
aaacctgtggtccattctcaaaa

SEQ ID NO: 1538 - DNA, 23 bp, Homo sapiens
tgctgatctctttttgggcccaa

SEQ ID NO: 1539 - DNA, 28 bp, Homo sapiens
tcccatataccatgttttcagtgactgt

SEQ ID NO: 1540 - DNA, 23 bp, Homo sapiens
tgggatcaagaggaaggtaggca

SEQ ID NO: 1541 - DNA, 25 bp, Homo sapiens
ccctcttaggaaatggactcctcca

SEQ ID NO: 1542 - DNA, 25 bp, Homo sapiens
acgtgtcatccaaaattaggcagga

SEQ ID NO: 1543 - DNA, 23 bp, Homo sapiens
attcctcgtaaggcccctcctgt

SEQ ID NO: 1544 - DNA, 23 bp, Homo sapiens
catgatagggtgggaaggtgcgg

SEQ ID NO: 1545 - DNA, 23 bp, Homo sapiens
acactgggtttgggcttgtctcc

SEQ ID NO: 1546 - DNA, 23 bp, Homo sapiens
cctcacagtatctcccccaccct

SEQ ID NO: 1547 - DNA, 23 bp, Homo sapiens
cctgcctgcagttggatctctcc

SEQ ID NO: 1548 - DNA, 23 bp, Homo sapiens
tcacagtacttcagccccctcca

SEQ ID NO: 1549 - DNA, 23 bp, Homo sapiens
acagaggcttcaatccctgacgc

SEQ ID NO: 1550 - DNA, 23 bp, Homo sapiens
accctgctcctgttccatcttcc

SEQ ID NO: 1551 - DNA, 25 bp, Homo sapiens
tggctgcattgcaaaacctaaatgt

SEQ ID NO: 1552 - DNA, 23 bp, Homo sapiens
aggacagggaaagccagcttgtg

SEQ ID NO: 1553 - DNA, 24 bp, Homo sapiens
tgttttccccactcagcaggaact

SEQ ID NO: 1554 - DNA, 23 bp, Homo sapiens
agcacttgcattttatgttttct

SEQ ID NO: 1555 - DNA, 26 bp, Homo sapiens
tggttgtctttaggttgagagtgaga

SEQ ID NO: 1556 - DNA, 23 bp, Homo sapiens
gcattatggtgctatggataagt

SEQ ID NO: 1557 - DNA, 27 bp, Homo sapiens
tgctgggaaacaattattacctcaggt

SEQ ID NO: 1558 - DNA, 24 bp, Homo sapiens
ccagtgcatttgggctgtaggtct

SEQ ID NO: 1559 - DNA, 23 bp, Homo sapiens
tgcagctatcatttgtcctgtca

SEQ ID NO: 1560 - DNA, 23 bp, Homo sapiens
gaagccgggctctggtctttgat

SEQ ID NO: 1561 - DNA, 23 bp, Homo sapiens
tgactgtggtcttatgccagcct

SEQ ID NO: 1562 - DNA, 24 bp, Homo sapiens
tcagtcgagtccttatcagccagt

SEQ ID NO: 1563 - DNA, 23 bp, Homo sapiens
gcactgttcttgagggagtggca

SEQ ID NO: 1564 - DNA, 24 bp, Homo sapiens
tggtttaggtaagccttcagagct

SEQ ID NO: 1565 - DNA, 23 bp, Homo sapiens
ttggggcatgttgttttctttcc

SEQ ID NO: 1566 - DNA, 23 bp, Homo sapiens
tccggggtggaggaggaaaagta

SEQ ID NO: 1567 - DNA, 25 bp, Homo sapiens
tggagaaatcctggtgattgtgcct

SEQ ID NO: 1568 - DNA, 23 bp, Homo sapiens
ttgttgacaccagcctcaccaca

SEQ ID NO: 1569 - DNA, 25 bp, Homo sapiens
tgcattttgactcactgcaccttga

SEQ ID NO: 1570 - DNA, 23 bp, Homo sapiens
tcaaattctgtactggaagtttt

SEQ ID NO: 1571 - DNA, 24 bp, Homo sapiens
acgcacatttttatgtagttgaga

SEQ ID NO: 1572 - DNA, 23 bp, Homo sapiens
aatttctcaaggccattgttgtt

SEQ ID NO: 1573 - DNA, 25 bp, Homo sapiens
accagagtctaggaccttaggaaca

SEQ ID NO: 1574 - DNA, 23 bp, Homo sapiens
tcccatcacccagaggctctctt

SEQ ID NO: 1575 - DNA, 23 bp, Homo sapiens
ggcaaacatgggcctctgaaaat

SEQ ID NO: 1576 - DNA, 24 bp, Homo sapiens
tgttaggagagatgggatggggca

SEQ ID NO: 1577 - DNA, 23 bp, Homo sapiens
tggtggtaaattcataactcttt

SEQ ID NO: 1578 - DNA, 23 bp, Homo sapiens
ggctctgtcccttattggctggg

SEQ ID NO: 1579 - DNA, 23 bp, Homo sapiens
ggagagatggacaagtggggtgg

SEQ ID NO: 1580 - DNA, 23 bp, Homo sapiens
ttgcaatatgtgagctgcagaga

SEQ ID NO: 1581 - DNA, 25 bp, Homo sapiens
aatagattttatatacaacatgtgt

SEQ ID NO: 1582 - DNA, 23 bp, Homo sapiens
gactgctgtctgctaatggatgt

SEQ ID NO: 1583 - DNA, 23 bp, Homo sapiens
cagaggtgggaaagcctgatggg

SEQ ID NO: 1584 - DNA, 23 bp, Homo sapiens
ggccagtcttctctctgacaggg

SEQ ID NO: 1585 - DNA, 23 bp, Homo sapiens
ggagttgtgcatgttggggaagc

SEQ ID NO: 1586 - DNA, 24 bp, Homo sapiens
ttccttttccctgttctgacaagt

SEQ ID NO: 1587 - DNA, 23 bp, Homo sapiens
tagcaggaaagcagcgaccttcg

SEQ ID NO: 1588 - DNA, 25 bp, Homo sapiens
agtgcgttaattctcaaaagaagga

SEQ ID NO: 1589 - DNA, 23 bp, Homo sapiens
agactgcatgagctctcaaagtt

SEQ ID NO: 1590 - DNA, 23 bp, Homo sapiens
ggagtccttgtggaactggagca

SEQ ID NO: 1591 - DNA, 20 bp, Homo sapiens
cctattggccgcgtccccag

SEQ ID NO: 1592 - DNA, 23 bp, Homo sapiens
gcggacttcgtgagcttctacgg

SEQ ID NO: 1593 - DNA, 23 bp, Homo sapiens
gatctgtcgcacattggaggcct

SEQ ID NO: 1594 - DNA, 23 bp, Homo sapiens
cccggagcctcacaaactccttt

SEQ ID NO: 1595 - DNA, 23 bp, Homo sapiens
gagtcgcctcctccagagagttt

SEQ ID NO: 1596 - DNA, 23 bp, Homo sapiens
gcaaacgaaggagcatgggagga

SEQ ID NO: 1597 - DNA, 23 bp, Homo sapiens
cacctcctacctcggctccaaga

SEQ ID NO: 1598 - DNA, 23 bp, Homo sapiens
tgggggaaacactaggctttcaa

SEQ ID NO: 1599 - DNA, 23 bp, Homo sapiens
agtggatgctgctgtcagatggc

SEQ ID NO: 1600 - DNA, 23 bp, Homo sapiens
tggaacccagggtgtttccttcc

SEQ ID NO: 1601 - DNA, 25 bp, Homo sapiens
aggaactggctgataattgacccgt

SEQ ID NO: 1602 - DNA, 23 bp, Homo sapiens
gcgggagagctgggaaggataac

SEQ ID NO: 1603 - DNA, 23 bp, Homo sapiens
ggtgattcttggcatccagggct

SEQ ID NO: 1604 - DNA, 23 bp, Homo sapiens
agtaaaatggtctggttcttccc

SEQ ID NO: 1605 - DNA, 23 bp, Homo sapiens
ccccgctccttccgttaaaccaa

SEQ ID NO: 1606 - DNA, 23 bp, Homo sapiens
ccagctctggtcttgcccacaaa

SEQ ID NO: 1607 - DNA, 23 bp, Homo sapiens
tgtttcaccctgaggacagtgcc

SEQ ID NO: 1608 - DNA, 26 bp, Homo sapiens
gggcctagggacattacattacaggc

SEQ ID NO: 1609 - DNA, 23 bp, Homo sapiens
attaggtggcgcctctgcacatt

SEQ ID NO: 1610 - DNA, 23 bp, Homo sapiens
caggggactctcctagggtcacc

SEQ ID NO: 1611 - DNA, 23 bp, Homo sapiens
acatgggctctgaataaatccct

SEQ ID NO: 1612 - DNA, 23 bp, Homo sapiens
agtggtacaaaagctggctggct

SEQ ID NO: 1613 - DNA, 24 bp, Homo sapiens
accattctgtttgcttctctctct

SEQ ID NO: 1614 - DNA, 23 bp, Homo sapiens
acagaatcttaatttgggtggct

SEQ ID NO: 1615 - DNA, 22 bp, Homo sapiens
cgccacctgggaaactgaggtc

SEQ ID NO: 1616 - DNA, 23 bp, Homo sapiens
gagatggaggctggggcaaaagt

SEQ ID NO: 1617 - DNA, 23 bp, Homo sapiens
tcccctcatgctgacagtaccct

SEQ ID NO: 1618 - DNA, 23 bp, Homo sapiens
actggcgtgattggacttaccgg

SEQ ID NO: 1619 - DNA, 23 bp, Homo sapiens
gggacctccatgaccttgctttt

SEQ ID NO: 1620 - DNA, 23 bp, Homo sapiens
tagggtacggggagagcttggac

SEQ ID NO: 1621 - DNA, 24 bp, Homo sapiens
accttgcagtgtgaagatttgcca

SEQ ID NO: 1622 - DNA, 24 bp, Homo sapiens
aggagaaactgttccttttgttgt

SEQ ID NO: 1623 - DNA, 23 bp, Homo sapiens
tgttattacctcacctcccagtt

SEQ ID NO: 1624 - DNA, 23 bp, Homo sapiens
tcagttcatccaacaaaagcaga

SEQ ID NO: 1625 - DNA, 23 bp, Homo sapiens
cagaagtggaactgtgcccttga

SEQ ID NO: 1626 - DNA, 24 bp, Homo sapiens
acgcctttacagtctaatttgcca

SEQ ID NO: 1627 - DNA, 25 bp, Homo sapiens
agtagataggtgttcatgtttacct

SEQ ID NO: 1628 - DNA, 25 bp, Homo sapiens
tcactaatgcaacaccagacagcca

SEQ ID NO: 1629 - DNA, 23 bp, Homo sapiens
aggcagagggtattgagcccaga

SEQ ID NO: 1630 - DNA, 23 bp, Homo sapiens
tcttgcctctgtgtgtgtgtgca

SEQ ID NO: 1631 - DNA, 23 bp, Homo sapiens
agcctcttcctttgtcgcagctc

SEQ ID NO: 1632 - DNA, 23 bp, Homo sapiens
tgtgtggaaatacagcgcctccg

SEQ ID NO: 1633 - DNA, 23 bp, Homo sapiens
gatgcttctctaactcccgggcc

SEQ ID NO: 1634 - DNA, 23 bp, Homo sapiens
gtcggggctaggtagagggaaca

SEQ ID NO: 1635 - DNA, 23 bp, Homo sapiens
gatcagagcccccaaagcagagg

SEQ ID NO: 1636 - DNA, 23 bp, Homo sapiens
cctgacactgtggttggcatgga

SEQ ID NO: 1637 - DNA, 23 bp, Homo sapiens
tggatgtctgtgccatggctagc

SEQ ID NO: 1638 - DNA, 23 bp, Homo sapiens
agcgggagggcagaagaagtttg

SEQ ID NO: 1639 - DNA, 23 bp, Homo sapiens
agacaggctgggtctttgttggg

SEQ ID NO: 1640 - DNA, 23 bp, Homo sapiens
gcctgtcaaaccagttgctgctg

SEQ ID NO: 1641 - DNA, 23 bp, Homo sapiens
aggcagcgtctttcagctgtagg

SEQ ID NO: 1642 - DNA, 23 bp, Homo sapiens
gggggtgtggtatctctttgttt

SEQ ID NO: 1643 - DNA, 23 bp, Homo sapiens
tctcactgcattttaaatggtat

SEQ ID NO: 1644 - DNA, 23 bp, Homo sapiens
aggcatgattgttgctgcacact

SEQ ID NO: 1645 - DNA, 23 bp, Homo sapiens
ctgctcagatgggctatggtgca

SEQ ID NO: 1646 - DNA, 23 bp, Homo sapiens
aggattgctgggaagggtaagga

SEQ ID NO: 1647 - DNA, 23 bp, Homo sapiens
gttgtaaatccctggcccatgca

SEQ ID NO: 1648 - DNA, 23 bp, Homo sapiens
agtgatcggaagctgcttggcat

SEQ ID NO: 1649 - DNA, 21 bp, Homo sapiens
acgcgcgtgttctccttaggg

SEQ ID NO: 1650 - DNA, 23 bp, Homo sapiens
aaggtatcactgtaaattctcat

SEQ ID NO: 1651 - DNA, 23 bp, Homo sapiens
cccacgccgaggatagattgagc

SEQ ID NO: 1652 - DNA, 23 bp, Homo sapiens
cctctgccggttttctcttgggt

SEQ ID NO: 1653 - DNA, 23 bp, Homo sapiens
acctttttgggcagcgttttcct

SEQ ID NO: 1654 - DNA, 24 bp, Homo sapiens
tctcatttttccctctccttccct

SEQ ID NO: 1655 - DNA, 23 bp, Homo sapiens
tggctctgtggaggtaaggcagt

SEQ ID NO: 1656 - DNA, 23 bp, Homo sapiens
agagggcctcctagacagaggaa

SEQ ID NO: 1657 - DNA, 23 bp, Homo sapiens
tgtttgggcttcggtttccaggt

SEQ ID NO: 1658 - DNA, 26 bp, Homo sapiens
agtgagcatttcaacttgattctcgt

SEQ ID NO: 1659 - DNA, 25 bp, Homo sapiens
tcttcctcactgtcctttttgtcct

SEQ ID NO: 1660 - DNA, 23 bp, Homo sapiens
gcacgggctcagtcccttgttaa

SEQ ID NO: 1661 - DNA, 23 bp, Homo sapiens
gccaggcaggaattagcacagtt

SEQ ID NO: 1662 - DNA, 23 bp, Homo sapiens
tagtacctcaggttcaggccgca

SEQ ID NO: 1663 - DNA, 22 bp, Homo sapiens
cggagtgtgggagttggcagag

SEQ ID NO: 1664 - DNA, 23 bp, Homo sapiens
agggcatgtttattctgggggca

SEQ ID NO: 1665 - DNA, 23 bp, Homo sapiens
gggaaggtgactgaggaggggta

SEQ ID NO: 1666 - DNA, 18 bp, Homo sapiens
cttgctaacggcgccccc

SEQ ID NO: 1667 - DNA, 20 bp, Homo sapiens
atggtccttcagagctcagg

SEQ ID NO: 1668 - DNA, 23 bp, Homo sapiens
aggcatgagctcgctttggttca

SEQ ID NO: 1669 - DNA, 23 bp, Homo sapiens
tggcaaatcttgtggaaacttct

SEQ ID NO: 1670 - DNA, 24 bp, Homo sapiens
tgcggaggaaaagaaggacaagct

SEQ ID NO: 1671 - DNA, 24 bp, Homo sapiens
tcagccacttagagatctcacact

SEQ ID NO: 1672 - DNA, 23 bp, Homo sapiens
tctggtagtgcagtgggtggaga

SEQ ID NO: 1673 - DNA, 23 bp, Homo sapiens
acgccttccctctcactcctcag

SEQ ID NO: 1674 - DNA, 23 bp, Homo sapiens
ttgagaaaggggtgctggggttg

SEQ ID NO: 1675 - DNA, 24 bp, Homo sapiens
tgcctctttccctagtctcttggc

SEQ ID NO: 1676 - DNA, 23 bp, Homo sapiens
acacaaagttcaagtgcttaact

SEQ ID NO: 1677 - DNA, 23 bp, Homo sapiens
gagtgtgaaggttgggggcagtt

SEQ ID NO: 1678 - DNA, 23 bp, Homo sapiens
ggagtatgtacaggctggctggc

SEQ ID NO: 1679 - DNA, 23 bp, Homo sapiens
actcttgcctaggttttctttca

SEQ ID NO: 1680 - DNA, 23 bp, Homo sapiens
tagctgcctctccacacacttgc

SEQ ID NO: 1681 - DNA, 23 bp, Homo sapiens
tggctgcaggcataaggataggg

SEQ ID NO: 1682 - DNA, 23 bp, Homo sapiens
tgcctgtttgtaagcagtcatct

SEQ ID NO: 1683 - DNA, 23 bp, Homo sapiens
gagaaagccggccaggtctttga

SEQ ID NO: 1684 - DNA, 23 bp, Homo sapiens
aagcccaagtagtttcgagccga

SEQ ID NO: 1685 - DNA, 23 bp, Homo sapiens
gctgattgctttgctgctgagtt

SEQ ID NO: 1686 - DNA, 25 bp, Homo sapiens
tgtgaagctctgcattattactcca

SEQ ID NO: 1687 - DNA, 25 bp, Homo sapiens
ggcatttgttttgtttttcgtttgt

SEQ ID NO: 1688 - DNA, 23 bp, Homo sapiens
gtaagcccctgtggatcttgcgt

SEQ ID NO: 1689 - DNA, 23 bp, Homo sapiens
aggcaaaacactgggtaactacc

SEQ ID NO: 1690 - DNA, 24 bp, Homo sapiens
tcatgttgcactttgatgcgctgt

SEQ ID NO: 1691 - DNA, 24 bp, Homo sapiens
tccctcctcctgacaatagctcct

SEQ ID NO: 1692 - DNA, 23 bp, Homo sapiens
aaggttggtggaagtcgcgttgt

SEQ ID NO: 1693 - DNA, 23 bp, Homo sapiens
acaagtaaacaaattaggtgctt

SEQ ID NO: 1694 - DNA, 24 bp, Homo sapiens
aacaatgatttatctttactttct

SEQ ID NO: 1695 - DNA, 24 bp, Homo sapiens
tccgtgaaaatggaaatagtggct

SEQ ID NO: 1696 - DNA, 23 bp, Homo sapiens
agctcctatttcccaccccctct

SEQ ID NO: 1697 - DNA, 23 bp, Homo sapiens
tacaccagcaacagccccttcac

SEQ ID NO: 1698 - DNA, 23 bp, Homo sapiens
tccagactcttgaatcttacatt

SEQ ID NO: 1699 - DNA, 24 bp, Homo sapiens
gtcctgatgatggttcatggacga

SEQ ID NO: 1700 - DNA, 24 bp, Homo sapiens
acataaatgtacgtgcactgatct

SEQ ID NO: 1701 - DNA, 27 bp, Homo sapiens
gcagttgctgtttaatcatgttgctgt

SEQ ID NO: 1702 - DNA, 23 bp, Homo sapiens
tctgttcttatgaaacattaaca

SEQ ID NO: 1703 - DNA, 26 bp, Homo sapiens
tcataaccagagcattacaattaggt

SEQ ID NO: 1704 - DNA, 23 bp, Homo sapiens
tgtgctacttgggaaggtcagca

SEQ ID NO: 1705 - DNA, 23 bp, Homo sapiens
aagagaattggatgcataaaggc

SEQ ID NO: 1706 - DNA, 23 bp, Homo sapiens
ctcctcaaacgcacccagaggag

SEQ ID NO: 1707 - DNA, 20 bp, Homo sapiens
ccgaaggctgagctgtggcg

SEQ ID NO: 1708 - DNA, 23 bp, Homo sapiens
tctggaagggtagggtcaccgag

SEQ ID NO: 1709 - DNA, 21 bp, Homo sapiens
gctccccatgccaggtgagtg

SEQ ID NO: 1710 - DNA, 23 bp, Homo sapiens
agaaaagagaggtccgtgggggt

SEQ ID NO: 1711 - DNA, 23 bp, Homo sapiens
acaatctctgcctggggaaagca

SEQ ID NO: 1712 - DNA, 23 bp, Homo sapiens
tctacgtctccgaggggtaagcc

SEQ ID NO: 1713 - DNA, 25 bp, Homo sapiens
ggccttgccctaaaaactgtttcct

SEQ ID NO: 1714 - DNA, 23 bp, Homo sapiens
ggatgcgcctctgaagtttccct

SEQ ID NO: 1715 - DNA, 19 bp, Homo sapiens
cgcagcctgacccctctct

SEQ ID NO: 1716 - DNA, 20 bp, Homo sapiens
ctctgcaatcccggccggtc

SEQ ID NO: 1717 - DNA, 23 bp, Homo sapiens
ccctgcaaaagacccctgactcc

SEQ ID NO: 1718 - DNA, 19 bp, Homo sapiens
ctcgccctggaggagctgc

SEQ ID NO: 1719 - DNA, 24 bp, Homo sapiens
tgtaaccctgcaaagctgaaacct

SEQ ID NO: 1720 - DNA, 23 bp, Homo sapiens
agcggtggagcttggcataaagt

SEQ ID NO: 1721 - DNA, 23 bp, Homo sapiens
acatgggtcttttctgaaataca

SEQ ID NO: 1722 - DNA, 24 bp, Homo sapiens
tttaaacacttatttgggggtagt

SEQ ID NO: 1723 - DNA, 23 bp, Homo sapiens
tcctcattttgctttgcatggga

SEQ ID NO: 1724 - DNA, 24 bp, Homo sapiens
gctggtcactggataagtcgtggg

SEQ ID NO: 1725 - DNA, 23 bp, Homo sapiens
acgcctggatttcatctccttca

SEQ ID NO: 1726 - DNA, 23 bp, Homo sapiens
cggagatagtgaaagctggggca

SEQ ID NO: 1727 - DNA, 23 bp, Homo sapiens
accaagttggcagagcagtatgc

SEQ ID NO: 1728 - DNA, 25 bp, Homo sapiens
aaaccatcactctgctcctttgtct

SEQ ID NO: 1729 - DNA, 23 bp, Homo sapiens
gcatctggccacccatcaccttt

SEQ ID NO: 1730 - DNA, 22 bp, Homo sapiens
gagtgtgctctcagattgactt

SEQ ID NO: 1731 - DNA, 23 bp, Homo sapiens
tcggggtgagatgagagaagggg

SEQ ID NO: 1732 - DNA, 23 bp, Homo sapiens
gcccttcactcaagcctgtggtt

SEQ ID NO: 1733 - DNA, 24 bp, Homo sapiens
acaagtggcccattttgatggtgt

SEQ ID NO: 1734 - DNA, 23 bp, Homo sapiens
cgctccctggcttcttcccttta

SEQ ID NO: 1735 - DNA, 25 bp, Homo sapiens
gggtcatcagtattcatgcagggct

SEQ ID NO: 1736 - DNA, 23 bp, Homo sapiens
agctgataactgacccagtagca

SEQ ID NO: 1737 - DNA, 23 bp, Homo sapiens
gaactaactgccccacctcctgc

SEQ ID NO: 1738 - DNA, 23 bp, Homo sapiens
gcctttggccatgttctgccaat

SEQ ID NO: 1739 - DNA, 23 bp, Homo sapiens
atccacagcaaggaggctcatgc

SEQ ID NO: 1740 - DNA, 23 bp, Homo sapiens
cctgccctgcttgagacacctat

SEQ ID NO: 1741 - DNA, 25 bp, Homo sapiens
gggcagttatgtgtactactccact

SEQ ID NO: 1742 - DNA, 23 bp, Homo sapiens
cttaagacccttggctgctgtgc

SEQ ID NO: 1743 - DNA, 23 bp, Homo sapiens
aaaaataggtattctggcgccca

SEQ ID NO: 1744 - DNA, 23 bp, Homo sapiens
gttcccctaaaggttggagcccc

SEQ ID NO: 1745 - DNA, 23 bp, Homo sapiens
tttgaacagacggccaagactgg

SEQ ID NO: 1746 - DNA, 23 bp, Homo sapiens
gagagatcgtactggccagctgc

SEQ ID NO: 1747 - DNA, 27 bp, Homo sapiens
tagctctatttgttttgttagtctgac

SEQ ID NO: 1748 - DNA, 26 bp, Homo sapiens
tccccttcactaacactcagtgtcct

SEQ ID NO: 1749 - DNA, 26 bp, Homo sapiens
tggattgaagttgcagagtaatgtga

SEQ ID NO: 1750 - DNA, 23 bp, Homo sapiens
aggaccctgaatacacctttcca

SEQ ID NO: 1751 - DNA, 26 bp, Homo sapiens
acccttttctacacctactgactggc

SEQ ID NO: 1752 - DNA, 23 bp, Homo sapiens
acaaggtcaggctaaattctgct

SEQ ID NO: 1753 - DNA, 23 bp, Homo sapiens
tttggggctctttaatgtgggga

SEQ ID NO: 1754 - DNA, 23 bp, Homo sapiens
gccacagcatcctggcatagtga

SEQ ID NO: 1755 - DNA, 23 bp, Homo sapiens
ttcacgtttagctgtatctcctt

SEQ ID NO: 1756 - DNA, 24 bp, Homo sapiens
tcttgaatggtttctgctaggtca

SEQ ID NO: 1757 - DNA, 23 bp, Homo sapiens
ccgactagccctccaggtcctag

SEQ ID NO: 1758 - DNA, 23 bp, Homo sapiens
ttgcttggcccctcgacaattct

SEQ ID NO: 1759 - DNA, 23 bp, Homo sapiens
aggagagaagcacagatgttaaa

SEQ ID NO: 1760 - DNA, 24 bp, Homo sapiens
tcaatggcagttttagcctgtgca

SEQ ID NO: 1761 - DNA, 23 bp, Homo sapiens
tcacttgaagcctcagtacccgg

SEQ ID NO: 1762 - DNA, 23 bp, Homo sapiens
tgtcctcccagacctcctcttgg

SEQ ID NO: 1763 - DNA, 23 bp, Homo sapiens
taatggccaaagcggtgcactct

SEQ ID NO: 1764 - DNA, 25 bp, Homo sapiens
tgatgtgtgcagcaattgagaacca

SEQ ID NO: 1765 - DNA, 23 bp, Homo sapiens
tgccttgtgccttgttgtgggta

SEQ ID NO: 1766 - DNA, 23 bp, Homo sapiens
cccacttctccagggtcagggat

SEQ ID NO: 1767 - DNA, 23 bp, Homo sapiens
ttcttactctcccctccccctgc

SEQ ID NO: 1768 - DNA, 24 bp, Homo sapiens
tgtagttccctggttgtaaacggt

SEQ ID NO: 1769 - DNA, 25 bp, Homo sapiens
aggagaaattgcatgtcgggtgagt

SEQ ID NO: 1770 - DNA, 22 bp, Homo sapiens
tgctgggcgcatctgttaatgc

SEQ ID NO: 1771 - DNA, 23 bp, Homo sapiens
ccagtgggcaggaagctatgtgg

SEQ ID NO: 1772 - DNA, 23 bp, Homo sapiens
tccgaggcacactgtttacccag

SEQ ID NO: 1773 - DNA, 23 bp, Homo sapiens
ttctggtagtgcttcctgccagc

SEQ ID NO: 1774 - DNA, 28 bp, Homo sapiens
tggtcaattgtcatgttcatacatccca

SEQ ID NO: 1775 - DNA, 23 bp, Homo sapiens
aaggcagggaaaacttgggtctt

SEQ ID NO: 1776 - DNA, 23 bp, Homo sapiens
gtggagggtgcagagaacagagc

SEQ ID NO: 1777 - DNA, 23 bp, Homo sapiens
cccaccccattcccacaaaaggt

SEQ ID NO: 1778 - DNA, 23 bp, Homo sapiens
tccacaccatttctccccagcag

SEQ ID NO: 1779 - DNA, 24 bp, Homo sapiens
agtaattgagctcctactctgtgc

SEQ ID NO: 1780 - DNA, 23 bp, Homo sapiens
agctttggatggctgctgaggac

SEQ ID NO: 1781 - DNA, 23 bp, Homo sapiens
ttgcctttcccagtaaggtgccc

SEQ ID NO: 1782 - DNA, 23 bp, Homo sapiens
cttacagaccgtgggccttcagg

SEQ ID NO: 1783 - DNA, 23 bp, Homo sapiens
ccccaggcagttcctccctctat

SEQ ID NO: 1784 - DNA, 23 bp, Homo sapiens
ctgagcagaaggttgaggggtgg

SEQ ID NO: 1785 - DNA, 23 bp, Homo sapiens
tctgctatggtccataaaagagt

SEQ ID NO: 1786 - DNA, 24 bp, Homo sapiens
cccgcatgattctcttgcaaagca

SEQ ID NO: 1787 - DNA, 23 bp, Homo sapiens
tttttctctgcgcgaccctcctc

SEQ ID NO: 1788 - DNA, 23 bp, Homo sapiens
tgatgggtagcaaaggcacgtgt

SEQ ID NO: 1789 - DNA, 23 bp, Homo sapiens
ggcgcacactgtctgtcctgatt

SEQ ID NO: 1790 - DNA, 23 bp, Homo sapiens
ctgggaaagtggggtgggattcc

SEQ ID NO: 1791 - DNA, 24 bp, Homo sapiens
agcagaagaagcagtgagagctct

SEQ ID NO: 1792 - DNA, 18 bp, Homo sapiens
ctggaatacagtggtgct

SEQ ID NO: 1793 - DNA, 23 bp, Homo sapiens
gctttggctcttgggtgtttggg

SEQ ID NO: 1794 - DNA, 23 bp, Homo sapiens
ccaggaggggaggggagagaaaa

SEQ ID NO: 1795 - DNA, 23 bp, Homo sapiens
ggaccctggcagctttgttgaga

SEQ ID NO: 1796 - DNA, 24 bp, Homo sapiens
tccattgacctttccctcatcact

SEQ ID NO: 1797 - DNA, 23 bp, Homo sapiens
tcggtttgacttcgctcagctga

SEQ ID NO: 1798 - DNA, 23 bp, Homo sapiens
tgggaaggaactctcgacctctc

SEQ ID NO: 1799 - DNA, 23 bp, Homo sapiens
ccgcctgtctgctgatggtatgt

SEQ ID NO: 1800 - DNA, 23 bp, Homo sapiens
tcgtatttgcctctgtgcgtgtt

SEQ ID NO: 1801 - DNA, 23 bp, Homo sapiens
agcaacctttccgtttgcatgga

SEQ ID NO: 1802 - DNA, 27 bp, Homo sapiens
ggttttctacatatcacaccattgtca

SEQ ID NO: 1803 - DNA, 25 bp, Homo sapiens
acaagctgttacacagatgaccgct

SEQ ID NO: 1804 - DNA, 23 bp, Homo sapiens
ccaatgccccttagtccactggt

SEQ ID NO: 1805 - DNA, 23 bp, Homo sapiens
agtagtgccttttggtgcctggg

SEQ ID NO: 1806 - DNA, 23 bp, Homo sapiens
cacccttaactgtctcccgaggc

SEQ ID NO: 1807 - DNA, 23 bp, Homo sapiens
aaggaacagagaagggggtttga

SEQ ID NO: 1808 - DNA, 23 bp, Homo sapiens
acaggcagagactgagcagcatc

SEQ ID NO: 1809 - DNA, 25 bp, Homo sapiens
tgccaacttgtgcttgtatgttgct

SEQ ID NO: 1810 - DNA, 23 bp, Homo sapiens
tatgtgtgtgtggtgagctgccg

SEQ ID NO: 1811 - DNA, 26 bp, Homo sapiens
aggtgaggtttagaggcataagtgga

SEQ ID NO: 1812 - DNA, 24 bp, Homo sapiens
gaaattttattgtttgcattttga

SEQ ID NO: 1813 - DNA, 23 bp, Homo sapiens
agccactttgcggatcaccatct

SEQ ID NO: 1814 - DNA, 20 bp, Homo sapiens
cttcgccgatgtccccgtcc

SEQ ID NO: 1815 - DNA, 26 bp, Homo sapiens
tccgtaaagatgctagcctgtgttgg

SEQ ID NO: 1816 - DNA, 23 bp, Homo sapiens
tgtctctgaccactgagccctgt

SEQ ID NO: 1817 - DNA, 23 bp, Homo sapiens
ttcccaacccacgtgttcccatc

SEQ ID NO: 1818 - DNA, 23 bp, Homo sapiens
aggagcgacatgaatgacgtgct

SEQ ID NO: 1819 - DNA, 23 bp, Homo sapiens
gtgaaggtcagcatgtgcccaga

SEQ ID NO: 1820 - DNA, 18 bp, Homo sapiens
cccgggcctcaggtgcac

SEQ ID NO: 1821 - DNA, 23 bp, Homo sapiens
cagcgcctcatcttcttcctgct

SEQ ID NO: 1822 - DNA, 23 bp, Homo sapiens
aaggtcacaaaaaggacccgggg

SEQ ID NO: 1823 - DNA, 24 bp, Homo sapiens
agtgaatgatacaccccctttgct

SEQ ID NO: 1824 - DNA, 23 bp, Homo sapiens
cagtctcttgcaatcattatcat

SEQ ID NO: 1825 - DNA, 23 bp, Homo sapiens
ggagacagtcagacaggaggggt

SEQ ID NO: 1826 - DNA, 23 bp, Homo sapiens
tgtgctctacctggtctgtgggt

SEQ ID NO: 1827 - DNA, 24 bp, Homo sapiens
tgtgctctgagtctctgaccacct

SEQ ID NO: 1828 - DNA, 23 bp, Homo sapiens
tgtaccacttgggctggggaaaa

SEQ ID NO: 1829 - DNA, 23 bp, Homo sapiens
ggtcccagcctcctttcagcaat

SEQ ID NO: 1830 - DNA, 23 bp, Homo sapiens
tactcctcccctgcatggtggaa

SEQ ID NO: 1831 - DNA, 23 bp, Homo sapiens
ttggagactgggaggcatctttt

SEQ ID NO: 1832 - DNA, 25 bp, Homo sapiens
tgtcacctgttttcctgctctctga

SEQ ID NO: 1833 - DNA, 26 bp, Homo sapiens
aggggatacttgaatgaaaaccctca

SEQ ID NO: 1834 - DNA, 23 bp, Homo sapiens
gtacttgggactgatgcggctgt

SEQ ID NO: 1835 - DNA, 23 bp, Homo sapiens
tctcctgaaacatcagtgatgca

SEQ ID NO: 1836 - DNA, 23 bp, Homo sapiens
tgggacaagggctgaaactacat

SEQ ID NO: 1837 - DNA, 23 bp, Homo sapiens
tgagaactgccctcctcccatca

SEQ ID NO: 1838 - DNA, 25 bp, Homo sapiens
tgaccagactgagatggtgttgtgt

SEQ ID NO: 1839 - DNA, 23 bp, Homo sapiens
tacagcttcttactctgttttct

SEQ ID NO: 1840 - DNA, 23 bp, Homo sapiens
ttgcacacggccaagttacctct

SEQ ID NO: 1841 - DNA, 26 bp, Homo sapiens
tgacaggtgtttgcaatgtttcacct

SEQ ID NO: 1842 - DNA, 24 bp, Homo sapiens
tgaactgttgggagataatggtca

SEQ ID NO: 1843 - DNA, 23 bp, Homo sapiens
tccacaagctactgacttttgct

SEQ ID NO: 1844 - DNA, 23 bp, Homo sapiens
aggttgtgtgtgtgtgagagact

SEQ ID NO: 1845 - DNA, 24 bp, Homo sapiens
tggtgctattaggcagatgagggc

SEQ ID NO: 1846 - DNA, 24 bp, Homo sapiens
tggtcatgattagttgcagttgct

SEQ ID NO: 1847 - DNA, 24 bp, Homo sapiens
gcacacgctttccaaatggatgca

SEQ ID NO: 1848 - DNA, 24 bp, Homo sapiens
acagaggagtttgttctggcagct

SEQ ID NO: 1849 - DNA, 23 bp, Homo sapiens
ttcggtcccacttgcagcagaaa

SEQ ID NO: 1850 - DNA, 23 bp, Homo sapiens
tgggagctcagaggaaacatgga

SEQ ID NO: 1851 - DNA, 23 bp, Homo sapiens
agccttccctgttcagtttggca

SEQ ID NO: 1852 - DNA, 25 bp, Homo sapiens
gcccccaaaacaaaaacagattgcc

SEQ ID NO: 1853 - DNA, 23 bp, Homo sapiens
gtggccagactcccattgctctt

SEQ ID NO: 1854 - DNA, 24 bp, Homo sapiens
cctgccccaagatcacacattcca

SEQ ID NO: 1855 - DNA, 23 bp, Homo sapiens
actaataattcaggccaagcgcg

SEQ ID NO: 1856 - DNA, 23 bp, Homo sapiens
tactctgtgcctcagccagtgga

SEQ ID NO: 1857 - DNA, 23 bp, Homo sapiens
cctgcaaggtgtcctttccctgt

SEQ ID NO: 1858 - DNA, 23 bp, Homo sapiens
cctgacagggccagcaaagcata

SEQ ID NO: 1859 - DNA, 23 bp, Homo sapiens
ctctgtcccccagcgctatgtta

SEQ ID NO: 1860 - DNA, 23 bp, Homo sapiens
ggctggttggagaagatggcagt

SEQ ID NO: 1861 - DNA, 23 bp, Homo sapiens
tgtgtcactgcactccaagtccg

SEQ ID NO: 1862 - DNA, 23 bp, Homo sapiens
attgctcccaactcacccacctg

SEQ ID NO: 1863 - DNA, 23 bp, Homo sapiens
acttcagcagaggaaggtctcaa

SEQ ID NO: 1864 - DNA, 23 bp, Homo sapiens
ttcaggctctgcactctggaaga

SEQ ID NO: 1865 - DNA, 23 bp, Homo sapiens
cccagtcatgcttcagggtaggg

SEQ ID NO: 1866 - DNA, 23 bp, Homo sapiens
gtcaagcagcatgtgtgtggcag

SEQ ID NO: 1867 - DNA, 23 bp, Homo sapiens
agacggcatcggtgtaagcatcc

SEQ ID NO: 1868 - DNA, 23 bp, Homo sapiens
tgataagttggcctctccctcct

SEQ ID NO: 1869 - DNA, 25 bp, Homo sapiens
tcccatccatactgggaagaaaagt

SEQ ID NO: 1870 - DNA, 23 bp, Homo sapiens
gacctcggtccagtcccctgttg

SEQ ID NO: 1871 - DNA, 22 bp, Homo sapiens
ggaggtgggacttagggtgggg

SEQ ID NO: 1872 - DNA, 23 bp, Homo sapiens
atgttggggaggtaggcagtcca

SEQ ID NO: 1873 - DNA, 23 bp, Homo sapiens
ctctgcccagatttgccctcctc

SEQ ID NO: 1874 - DNA, 23 bp, Homo sapiens
gtgagccactgaagatgggggtc

SEQ ID NO: 1875 - DNA, 23 bp, Homo sapiens
agggagaggccttttccttgcag

SEQ ID NO: 1876 - DNA, 19 bp, Homo sapiens
actaggcctgcctctcgca

SEQ ID NO: 1877 - DNA, 23 bp, Homo sapiens
tgggcactcctactgctcctcat

SEQ ID NO: 1878 - DNA, 23 bp, Homo sapiens
ctccaccctctccatcccgtcac

SEQ ID NO: 1879 - DNA, 23 bp, Homo sapiens
gtgactggatggaacggggagac

SEQ ID NO: 1880 - DNA, 26 bp, Homo sapiens
tggttatcagttaacatgggtcctgt

SEQ ID NO: 1881 - DNA, 23 bp, Homo sapiens
gtggctcgacatgtcaagaggct

SEQ ID NO: 1882 - DNA, 23 bp, Homo sapiens
aggatagacaaaagtcaacgaaa

SEQ ID NO: 1883 - DNA, 23 bp, Homo sapiens
cttggggcctggtcctcctgttc

SEQ ID NO: 1884 - DNA, 23 bp, Homo sapiens
tcctggagcaacaaagtgcacca

SEQ ID NO: 1885 - DNA, 22 bp, Homo sapiens
ctacctccctgccacacccctg

SEQ ID NO: 1886 - DNA, 23 bp, Homo sapiens
ggaaatgtgggccctagagcagg

SEQ ID NO: 1887 - DNA, 23 bp, Homo sapiens
tgtccatcccaggagagccagag

SEQ ID NO: 1888 - DNA, 23 bp, Homo sapiens
caagcagcttcccttcctacccc

SEQ ID NO: 1889 - DNA, 23 bp, Homo sapiens
cctcgagacagacagggcttgac

SEQ ID NO: 1890 - DNA, 23 bp, Homo sapiens
ccccggctgtggttttcaacatg

SEQ ID NO: 1891 - DNA, 23 bp, Homo sapiens
ctcaaagaagcctctgcccctcc

SEQ ID NO: 1892 - DNA, 24 bp, Homo sapiens
aggactttcatggtttgacggtga

SEQ ID NO: 1893 - DNA, 23 bp, Homo sapiens
tctctctccttgcaaaccaaaaa

SEQ ID NO: 1894 - DNA, 24 bp, Homo sapiens
agttgtcaggcaagattcaaatca

SEQ ID NO: 1895 - DNA, 23 bp, Homo sapiens
agcccacttttctgtcattacaa

SEQ ID NO: 1896 - DNA, 23 bp, Homo sapiens
cctgctccgacaccacaataccc

SEQ ID NO: 1897 - DNA, 23 bp, Homo sapiens
tcaggaagaatggagtgtgagtt

SEQ ID NO: 1898 - DNA, 25 bp, Homo sapiens
tcccaggctcttctaattaggggga

SEQ ID NO: 1899 - DNA, 26 bp, Homo sapiens
aggtttaggtgcaagttaaggttgga

SEQ ID NO: 1900 - DNA, 23 bp, Homo sapiens
acatgtgttctggctggcacaat

SEQ ID NO: 1901 - DNA, 23 bp, Homo sapiens
aacaagagctgagttaggtagtt

SEQ ID NO: 1902 - DNA, 23 bp, Homo sapiens
tggcatccttgacacatcattgt

SEQ ID NO: 1903 - DNA, 23 bp, Homo sapiens
aggccttccagttccacaaacat

SEQ ID NO: 1904 - DNA, 23 bp, Homo sapiens
aggatctggatcagaacgtgcca

SEQ ID NO: 1905 - DNA, 23 bp, Homo sapiens
agccttctccacaggttggtact

SEQ ID NO: 1906 - DNA, 23 bp, Homo sapiens
agagaaacacactgaacatacaa

SEQ ID NO: 1907 - DNA, 23 bp, Homo sapiens
gccagggccacttagatgaggaa

SEQ ID NO: 1908 - DNA, 23 bp, Homo sapiens
gtaggggtctgtgcaggaaccag

SEQ ID NO: 1909 - DNA, 23 bp, Homo sapiens
ccacaggctggacaagggaaact

SEQ ID NO: 1910 - DNA, 23 bp, Homo sapiens
acctcagggcctgttctgtccag

SEQ ID NO: 1911 - DNA, 23 bp, Homo sapiens
tgtgcaggagctggcgtcttaaa

SEQ ID NO: 1912 - DNA, 23 bp, Homo sapiens
ctcccaggcattggtgatccagg

SEQ ID NO: 1913 - DNA, 23 bp, Homo sapiens
gaagctcaggccttgacaccctc

SEQ ID NO: 1914 - DNA, 23 bp, Homo sapiens
tttcttccccaacgtgagcccag

SEQ ID NO: 1915 - DNA, 23 bp, Homo sapiens
aggccatgcgattctcagcgtag

SEQ ID NO: 1916 - DNA, 23 bp, Homo sapiens
agggccatgtctgccaacttgaa

SEQ ID NO: 1917 - DNA, 23 bp, Homo sapiens
acatgggggtacagtcagagcct

SEQ ID NO: 1918 - DNA, 23 bp, Homo sapiens
cgtagatctcagtgatgcgggcg

SEQ ID NO: 1919 - DNA, 23 bp, Homo sapiens
gctgagctgggctactcaacgaa

SEQ ID NO: 1920 - DNA, 23 bp, Homo sapiens
tctttggtgtagcctactccccc

SEQ ID NO: 1921 - DNA, 25 bp, Homo sapiens
tccagccacataaatagagccacca

SEQ ID NO: 1922 - DNA, 23 bp, Homo sapiens
agtggatctcctgtgcctaagtt

SEQ ID NO: 1923 - DNA, 23 bp, Homo sapiens
ctgaagggggtcggggtcataga

SEQ ID NO: 1924 - DNA, 23 bp, Homo sapiens
caaaacctgatccagccccaagc

SEQ ID NO: 1925 - DNA, 23 bp, Homo sapiens
agacccaattcatgaccagagga

SEQ ID NO: 1926 - DNA, 23 bp, Homo sapiens
ttgactgggaaatgcagggttca

SEQ ID NO: 1927 - DNA, 23 bp, Homo sapiens
accgcattgtggtcttggatagt

SEQ ID NO: 1928 - DNA, 25 bp, Homo sapiens
tgccagctcaagtctgacattttca

SEQ ID NO: 1929 - DNA, 23 bp, Homo sapiens
cacctgtcttgcacacctcctgt

SEQ ID NO: 1930 - DNA, 24 bp, Homo sapiens
acactgttaccaccaagccattgt

SEQ ID NO: 1931 - DNA, 23 bp, Homo sapiens
gcctcaaggactactgctctgcc

SEQ ID NO: 1932 - DNA, 23 bp, Homo sapiens
cacggaggggaggaacgaaactc

SEQ ID NO: 1933 - DNA, 23 bp, Homo sapiens
ggcaccgagaatgcactctctgt

SEQ ID NO: 1934 - DNA, 23 bp, Homo sapiens
ttgccaaggctgcggtgacttac

SEQ ID NO: 1935 - DNA, 23 bp, Homo sapiens
aggggtgggaatctgacttgtcc

SEQ ID NO: 1936 - DNA, 23 bp, Homo sapiens
gccccgagtcattccttacctcg

SEQ ID NO: 1937 - DNA, 23 bp, Homo sapiens
cccagggcaggtgcttagaagag

SEQ ID NO: 1938 - DNA, 23 bp, Homo sapiens
tgatgcctccccaaaaccttccc

SEQ ID NO: 1939 - DNA, 23 bp, Homo sapiens
cgaagcccctctccaccacaaaa

SEQ ID NO: 1940 - DNA, 23 bp, Homo sapiens
gctaaggaggcctggctatgtcc

SEQ ID NO: 1941 - DNA, 23 bp, Homo sapiens
ctagcaagtcgggctgctggtag

SEQ ID NO: 1942 - DNA, 23 bp, Homo sapiens
gtaaagctggagacccactgccc

SEQ ID NO: 1943 - DNA, 23 bp, Homo sapiens
aggctgcctcctagggacaaaga

SEQ ID NO: 1944 - DNA, 23 bp, Homo sapiens
tttagagcactgccaagcccaga

SEQ ID NO: 1945 - DNA, 23 bp, Homo sapiens
gggcggaatggtgtagagctcac

SEQ ID NO: 1946 - DNA, 22 bp, Homo sapiens
ggagagggaaggaggggttggg

SEQ ID NO: 1947 - DNA, 24 bp, Homo sapiens
acctactattcttgccagtggtgt

SEQ ID NO: 1948 - DNA, 23 bp, Homo sapiens
tctgccacaagtacaacctaggt

SEQ ID NO: 1949 - DNA, 23 bp, Homo sapiens
ataggttctacagcagcgtcagc

SEQ ID NO: 1950 - DNA, 23 bp, Homo sapiens
ttccctccgctttgtggttacca

SEQ ID NO: 1951 - DNA, 24 bp, Homo sapiens
agctagaaacacaaaggcagctct

SEQ ID NO: 1952 - DNA, 24 bp, Homo sapiens
tgttttgggatttcatcattttga

SEQ ID NO: 1953 - DNA, 23 bp, Homo sapiens
gtttttggaccagaacccgtcgc

SEQ ID NO: 1954 - DNA, 23 bp, Homo sapiens
acactgcccagttctagagggaa

SEQ ID NO: 1955 - DNA, 23 bp, Homo sapiens
tgctcccttaacacaaaaagcca

SEQ ID NO: 1956 - DNA, 23 bp, Homo sapiens
agctgggattagtgcaccaccac

SEQ ID NO: 1957 - DNA, 26 bp, Homo sapiens
acccagcctacgctatcattttgacc

SEQ ID NO: 1958 - DNA, 23 bp, Homo sapiens
ccagtggtggtgcagatccagac

SEQ ID NO: 1959 - DNA, 23 bp, Homo sapiens
caagcagttgccagctaagcgtc

SEQ ID NO: 1960 - DNA, 24 bp, Homo sapiens
tctctgaactggcaactcttcact

SEQ ID NO: 1961 - DNA, 28 bp, Homo sapiens
tgccaatgaagaccctatcatagactgc

SEQ ID NO: 1962 - DNA, 23 bp, Homo sapiens
aagagactctccccgatcccacc

SEQ ID NO: 1963 - DNA, 23 bp, Homo sapiens
gacgtgttgtctttttgtgcatt

SEQ ID NO: 1964 - DNA, 21 bp, Homo sapiens
ggatacagcagccctccgtgc

SEQ ID NO: 1965 - DNA, 23 bp, Homo sapiens
gcgccttcttgtcaatcttgccc

SEQ ID NO: 1966 - DNA, 23 bp, Homo sapiens
tgacaccagggacggtctccttg

SEQ ID NO: 1967 - DNA, 23 bp, Homo sapiens
cgacgtaggaggcatcgttagcg

SEQ ID NO: 1968 - DNA, 20 bp, Homo sapiens
cgaaaccatcacggcgccag

SEQ ID NO: 1969 - DNA, 23 bp, Homo sapiens
gaaaggcgcctagtctgagggtg

SEQ ID NO: 1970 - DNA, 23 bp, Homo sapiens
agcactgcttcccagaacttagt

SEQ ID NO: 1971 - DNA, 23 bp, Homo sapiens
gtgcatcctgagtgctctcctgg

SEQ ID NO: 1972 - DNA, 23 bp, Homo sapiens
cctctgcccactgctctgtgaac

SEQ ID NO: 1973 - DNA, 23 bp, Homo sapiens
tcagaggcaggagtgtcagctga

SEQ ID NO: 1974 - DNA, 23 bp, Homo sapiens
tcactcaacgtgggcagcaatga

SEQ ID NO: 1975 - DNA, 23 bp, Homo sapiens
catggaaggcagcacccgtctag

SEQ ID NO: 1976 - DNA, 23 bp, Homo sapiens
gtgcggccttcaggtctctaagg

SEQ ID NO: 1977 - DNA, 23 bp, Homo sapiens
aggcatcatcacacaggtggctc

SEQ ID NO: 1978 - DNA, 23 bp, Homo sapiens
ggggcatgctgggacttgtagtc

SEQ ID NO: 1979 - DNA, 23 bp, Homo sapiens
ccaacagtgaccttcccagccag

SEQ ID NO: 1980 - DNA, 23 bp, Homo sapiens
ccgtagccctccccagttctttg

SEQ ID NO: 1981 - DNA, 23 bp, Homo sapiens
tagcctcgcaccctcagaagtca

SEQ ID NO: 1982 - DNA, 23 bp, Homo sapiens
gtcctgagctgcagccactgtag

SEQ ID NO: 1983 - DNA, 23 bp, Homo sapiens
gacaggcctcatccatggtggtc

SEQ ID NO: 1984 - DNA, 23 bp, Homo sapiens
cagcactcctctgcactcccatc

SEQ ID NO: 1985 - DNA, 23 bp, Homo sapiens
taagagggcagacaggcaagcac

SEQ ID NO: 1986 - DNA, 23 bp, Homo sapiens
gtggctgggacctccatcatgac

SEQ ID NO: 1987 - DNA, 23 bp, Homo sapiens
cagacgggccaccacacttacag

SEQ ID NO: 1988 - DNA, 23 bp, Homo sapiens
cctggctcacctgcagcatatga

SEQ ID NO: 1989 - DNA, 23 bp, Homo sapiens
agggaactggacaggacctagca

SEQ ID NO: 1990 - DNA, 23 bp, Homo sapiens
agcccatttgctggctcatgact

SEQ ID NO: 1991 - DNA, 23 bp, Homo sapiens
ggtaatcccccaccaccaaaccc

SEQ ID NO: 1992 - DNA, 23 bp, Homo sapiens
tggcctctgtgctaagcagtcaa

SEQ ID NO: 1993 - DNA, 23 bp, Homo sapiens
cagccagacacgccaaacacctc

SEQ ID NO: 1994 - DNA, 24 bp, Homo sapiens
gggctggctagtcttatcaagggt

SEQ ID NO: 1995 - DNA, 23 bp, Homo sapiens
aggggcagccactagtcacagta

SEQ ID NO: 1996 - DNA, 23 bp, Homo sapiens
gtgtgagctggtccgtcactcag

SEQ ID NO: 1997 - DNA, 24 bp, Homo sapiens
ccatccccaagtttacacacaggc

SEQ ID NO: 1998 - DNA, 23 bp, Homo sapiens
tggctgagatcacgagccacaaa

SEQ ID NO: 1999 - DNA, 23 bp, Homo sapiens
acccccgttcttgcacacacaat

SEQ ID NO: 2000 - DNA, 23 bp, Homo sapiens
acttcaaattgagcgaagtctgt

SEQ ID NO: 2001 - DNA, 24 bp, Homo sapiens
accaaccctttgcttattggctgc

SEQ ID NO: 2002 - DNA, 25 bp, Homo sapiens
acacaaagggacaaaaatggaggca

SEQ ID NO: 2003 - DNA, 23 bp, Homo sapiens
agctggtgtgaaagatgggtcca

SEQ ID NO: 2004 - DNA, 23 bp, Homo sapiens
tcagctgggacttggtttcaggt

SEQ ID NO: 2005 - DNA, 24 bp, Homo sapiens
tcttgaattttacaccaagaggga

SEQ ID NO: 2006 - DNA, 23 bp, Homo sapiens
ctcagggatttggtgggagcctg

SEQ ID NO: 2007 - DNA, 23 bp, Homo sapiens
tgcatggcagcagtttctgtcct

SEQ ID NO: 2008 - DNA, 23 bp, Homo sapiens
cttgcacccattcctgagctccc

SEQ ID NO: 2009 - DNA, 23 bp, Homo sapiens
ggcaccatactgctccacactgt

SEQ ID NO: 2010 - DNA, 22 bp, Homo sapiens
agtccctgactgtccccactgg

SEQ ID NO: 2011 - DNA, 23 bp, Homo sapiens
cccctaggtctcctgttcaggct

SEQ ID NO: 2012 - DNA, 23 bp, Homo sapiens
ctgctgagctagactggcatggg

SEQ ID NO: 2013 - DNA, 23 bp, Homo sapiens
agagtcccccgctgagcagataa

SEQ ID NO: 2014 - DNA, 23 bp, Homo sapiens
gaagcagggctaagctggaggac

SEQ ID NO: 2015 - DNA, 23 bp, Homo sapiens
catgccccacccactttacccat

SEQ ID NO: 2016 - DNA, 23 bp, Homo sapiens
ccttgctccggatcagctccaaa

SEQ ID NO: 2017 - DNA, 23 bp, Homo sapiens
gaactggcacgtactagccaggc

SEQ ID NO: 2018 - DNA, 23 bp, Homo sapiens
aataggcaaggtcagtggccagc

SEQ ID NO: 2019 - DNA, 23 bp, Homo sapiens
tttggaggctaggaggaccggag

SEQ ID NO: 2020 - DNA, 23 bp, Homo sapiens
aaggggacagggtctcagggatc

SEQ ID NO: 2021 - DNA, 23 bp, Homo sapiens
ctcatgccctgcactttccctca

SEQ ID NO: 2022 - DNA, 23 bp, Homo sapiens
ccaagtgggggtcagaatgaggt

SEQ ID NO: 2023 - DNA, 23 bp, Homo sapiens
aggaacctaggaccccaatgcct

SEQ ID NO: 2024 - DNA, 23 bp, Homo sapiens
ccgaaaacacaaaggttggccta

SEQ ID NO: 2025 - DNA, 23 bp, Homo sapiens
ctgacaacccagacagaggctgg

SEQ ID NO: 2026 - DNA, 23 bp, Homo sapiens
agggaaggtatgtgggtggggaa

SEQ ID NO: 2027 - DNA, 23 bp, Homo sapiens
gtgctcatctccttcccacaccc

SEQ ID NO: 2028 - DNA, 23 bp, Homo sapiens
aggtgctgcagatgctagtgctc

SEQ ID NO: 2029 - DNA, 23 bp, Homo sapiens
ccgggaagggggctatagggaaa

SEQ ID NO: 2030 - DNA, 23 bp, Homo sapiens
gtcctttggaatgagcccgggag

SEQ ID NO: 2031 - DNA, 23 bp, Homo sapiens
ttcaaatgcagcgaggagacggt

SEQ ID NO: 2032 - DNA, 23 bp, Homo sapiens
gtcaacccccttcgagtcccaac

SEQ ID NO: 2033 - DNA, 23 bp, Homo sapiens
cggcctaatgatcccttggaggc

SEQ ID NO: 2034 - DNA, 23 bp, Homo sapiens
ctgcacacccaggactgactcag

SEQ ID NO: 2035 - DNA, 23 bp, Homo sapiens
taacagaaagcctcatatgcagt

SEQ ID NO: 2036 - DNA, 23 bp, Homo sapiens
caccttatgcccgtcctgagagc

SEQ ID NO: 2037 - DNA, 23 bp, Homo sapiens
agaggagttgttggtaatggggt

SEQ ID NO: 2038 - DNA, 27 bp, Homo sapiens
agtgtcacgttaaacagctataggtca

SEQ ID NO: 2039 - DNA, 25 bp, Homo sapiens
tcaggtgggaatttcgaaaacacca

SEQ ID NO: 2040 - DNA, 23 bp, Homo sapiens
tggggactttgctagggatgcaa

SEQ ID NO: 2041 - DNA, 23 bp, Homo sapiens
acagagcccacgcatccctttac

SEQ ID NO: 2042 - DNA, 24 bp, Homo sapiens
tgtcataagcttcagggcactggt

SEQ ID NO: 2043 - DNA, 23 bp, Homo sapiens
ctaaggcagatcggcacagctgt

SEQ ID NO: 2044 - DNA, 23 bp, Homo sapiens
ccctgacaatgtaacagccggga

SEQ ID NO: 2045 - DNA, 23 bp, Homo sapiens
tctaaggtggagaagctgggggt

SEQ ID NO: 2046 - DNA, 23 bp, Homo sapiens
ccttcagggaccccacactctga

SEQ ID NO: 2047 - DNA, 19 bp, Homo sapiens
cccccgcccctagtcctgt

SEQ ID NO: 2048 - DNA, 23 bp, Homo sapiens
cctccagagtcctaaccctggct

SEQ ID NO: 2049 - DNA, 23 bp, Homo sapiens
aatcattactatggccaggcatg

SEQ ID NO: 2050 - DNA, 23 bp, Homo sapiens
ttccacccagaaggcaggcaaaa

SEQ ID NO: 2051 - DNA, 23 bp, Homo sapiens
gcaggattggggagggaaggaga

SEQ ID NO: 2052 - DNA, 23 bp, Homo sapiens
aggcaagggggagatgcaacatc

SEQ ID NO: 2053 - DNA, 23 bp, Homo sapiens
aatccttcccaagctctgcaggc

SEQ ID NO: 2054 - DNA, 23 bp, Homo sapiens
tgaaagcatgcactacatttcca

SEQ ID NO: 2055 - DNA, 24 bp, Homo sapiens
agttgccttttaccaactttacca

SEQ ID NO: 2056 - DNA, 23 bp, Homo sapiens
cctgaggcaaggaggttccagag

SEQ ID NO: 2057 - DNA, 25 bp, Homo sapiens
acaccaaaggttcttggacagaaga

SEQ ID NO: 2058 - DNA, 23 bp, Homo sapiens
agaatgcaggtaagggtgggtgg

SEQ ID NO: 2059 - DNA, 25 bp, Homo sapiens
acttgctgtaaaactgggcattgga

SEQ ID NO: 2060 - DNA, 23 bp, Homo sapiens
ggcaggggacagacagaaaagat

SEQ ID NO: 2061 - DNA, 24 bp, Homo sapiens
tgttgctaccacttcagatttcct

SEQ ID NO: 2062 - DNA, 23 bp, Homo sapiens
agcatcagtagcaccagacttaa

SEQ ID NO: 2063 - DNA, 24 bp, Homo sapiens
cagggaaatgacattctatcacca

SEQ ID NO: 2064 - DNA, 25 bp, Homo sapiens
acacagctaccacaattcaggcaca

SEQ ID NO: 2065 - DNA, 23 bp, Homo sapiens
agagagggagagaggccttgagc

SEQ ID NO: 2066 - DNA, 23 bp, Homo sapiens
gtggccctgacacctttaggcaa

SEQ ID NO: 2067 - DNA, 23 bp, Homo sapiens
gtggtccaagcccaacctctcag

SEQ ID NO: 2068 - DNA, 23 bp, Homo sapiens
acatgcggattccaagcctcgaa

SEQ ID NO: 2069 - DNA, 23 bp, Homo sapiens
acctggcaaagtccacccacttc

SEQ ID NO: 2070 - DNA, 23 bp, Homo sapiens
taggagcgagggttcagtcaggg

SEQ ID NO: 2071 - DNA, 21 bp, Homo sapiens
gcccccaagccagcacatcaa

SEQ ID NO: 2072 - DNA, 23 bp, Homo sapiens
aagcagctcatggccatctcagg

SEQ ID NO: 2073 - DNA, 23 bp, Homo sapiens
ccaaaggctgtggggtcagatcc

SEQ ID NO: 2074 - DNA, 23 bp, Homo sapiens
aatgacggaactggtgctggagg

SEQ ID NO: 2075 - DNA, 23 bp, Homo sapiens
aaaactgatgcccgaagctgggt

SEQ ID NO: 2076 - DNA, 22 bp, Homo sapiens
cagccctccccaagtccaactg

SEQ ID NO: 2077 - DNA, 23 bp, Homo sapiens
tcccccaacaccagtcctgatca

SEQ ID NO: 2078 - DNA, 23 bp, Homo sapiens
agggtggtaggaagcctgggatt

SEQ ID NO: 2079 - DNA, 24 bp, Homo sapiens
tgtggcacatggatctttgggagt

SEQ ID NO: 2080 - DNA, 23 bp, Homo sapiens
aggcaacagcaaaagctttctga

SEQ ID NO: 2081 - DNA, 23 bp, Homo sapiens
tagccttcctttccccagacagg

SEQ ID NO: 2082 - DNA, 23 bp, Homo sapiens
atacaagcgcccatagagagccg

SEQ ID NO: 2083 - DNA, 19 bp, Homo sapiens
tcctgggtgtcacttgatc

SEQ ID NO: 2084 - DNA, 23 bp, Homo sapiens
gagtgctctcctgcctgtcacac

SEQ ID NO: 2085 - DNA, 23 bp, Homo sapiens
gcagacagaacccaggactgagc

SEQ ID NO: 2086 - DNA, 23 bp, Homo sapiens
gactgcgcatctgtttgagctgc

SEQ ID NO: 2087 - DNA, 23 bp, Homo sapiens
tgagcctctgcatgctggacaaa

SEQ ID NO: 2088 - DNA, 23 bp, Homo sapiens
gactttccgacaagggccagctg

SEQ ID NO: 2089 - DNA, 23 bp, Homo sapiens
gctccccacacatcctcttggtc

SEQ ID NO: 2090 - DNA, 23 bp, Homo sapiens
gcctttaatccactctgcgcagt

SEQ ID NO: 2091 - DNA, 23 bp, Homo sapiens
tggctgtgtggtgtccaggtaac

SEQ ID NO: 2092 - DNA, 23 bp, Homo sapiens
ggaagctaggttgggacacaggc

SEQ ID NO: 2093 - DNA, 23 bp, Homo sapiens
cctcacaatctcagcccccagtg

SEQ ID NO: 2094 - DNA, 23 bp, Homo sapiens
actgctgcaggatctcatcagcg

SEQ ID NO: 2095 - DNA, 23 bp, Homo sapiens
attatctgcaggaggagcccctg

SEQ ID NO: 2096 - DNA, 23 bp, Homo sapiens
cgtgaggaatgacagctttcagc

SEQ ID NO: 2097 - DNA, 23 bp, Homo sapiens
gagggtgagttacaggctgcacc

SEQ ID NO: 2098 - DNA, 23 bp, Homo sapiens
tgccatgagagcttcagccttgt

SEQ ID NO: 2099 - DNA, 23 bp, Homo sapiens
gaagggtggcaggatggagagga

SEQ ID NO: 2100 - DNA, 23 bp, Homo sapiens
ggtcacctgttcgttccctggtc

SEQ ID NO: 2101 - DNA, 23 bp, Homo sapiens
caacccatacacacgccctcctc

SEQ ID NO: 2102 - DNA, 24 bp, Homo sapiens
tctccaaaaataccttccagcact

SEQ ID NO: 2103 - DNA, 28 bp, Homo sapiens
ggaaacataaatatatgtagactaaccg

SEQ ID NO: 2104 - DNA, 26 bp, Homo sapiens
aggcaaacaaatacactgacaccaag

SEQ ID NO: 2105 - DNA, 23 bp, Homo sapiens
agcatgaggcggtgagaaaaggt

SEQ ID NO: 2106 - DNA, 23 bp, Homo sapiens
gtccaggagacaggagcatctcc

SEQ ID NO: 2107 - DNA, 23 bp, Homo sapiens
tcaggacagactgcctccttcgt

SEQ ID NO: 2108 - DNA, 24 bp, Homo sapiens
agcctttagagagaaggctgtcct

SEQ ID NO: 2109 - DNA, 23 bp, Homo sapiens
tgtatacatccccaaactatctt

SEQ ID NO: 2110 - DNA, 23 bp, Homo sapiens
ggagtgcggtggctactcacaat

SEQ ID NO: 2111 - DNA, 23 bp, Homo sapiens
accacaggccctattgatggtgg

SEQ ID NO: 2112 - DNA, 23 bp, Homo sapiens
caggtttgggccaggtaagcagt

SEQ ID NO: 2113 - DNA, 27 bp, Homo sapiens
agtttccttttatatacacatgcatgt

SEQ ID NO: 2114 - DNA, 25 bp, Homo sapiens
gttgacaggtacaagaaccagttgg

SEQ ID NO: 2115 - DNA, 23 bp, Homo sapiens
ggacggcagccttactttgaaac

SEQ ID NO: 2116 - DNA, 23 bp, Homo sapiens
acaggtgaaagaatgctcactgc

SEQ ID NO: 2117 - DNA, 23 bp, Homo sapiens
aatctcaccctctggccaggact

SEQ ID NO: 2118 - DNA, 23 bp, Homo sapiens
cctcagggggccaaatgactgtc

SEQ ID NO: 2119 - DNA, 25 bp, Homo sapiens
tggtcaggattgaaagtgtgcaaca

SEQ ID NO: 2120 - DNA, 24 bp, Homo sapiens
acttgatggtaagtacatgggtgt

SEQ ID NO: 2121 - DNA, 23 bp, Homo sapiens
gcaggtagtgggggtagagggat

SEQ ID NO: 2122 - DNA, 26 bp, Homo sapiens
ccccatggttgaaaagctgattgtgg

SEQ ID NO: 2123 - DNA, 23 bp, Homo sapiens
aggcagaggtaactgttccacga

SEQ ID NO: 2124 - DNA, 23 bp, Homo sapiens
tcgtgggacagtcacctcatgga

SEQ ID NO: 2125 - DNA, 23 bp, Homo sapiens
accatcctgtcccctgtgaaaga

SEQ ID NO: 2126 - DNA, 23 bp, Homo sapiens
tccagatcctggaaatcagggtt

SEQ ID NO: 2127 - DNA, 22 bp, Homo sapiens
taggttctcccctgtcccagtt

SEQ ID NO: 2128 - DNA, 23 bp, Homo sapiens
tggagtgagagactgatgaaaca

SEQ ID NO: 2129 - DNA, 28 bp, Homo sapiens
acttataatatgtttgctttctcttctc

SEQ ID NO: 2130 - DNA, 23 bp, Homo sapiens
aaattgccacccgtgttccagga

SEQ ID NO: 2131 - DNA, 23 bp, Homo sapiens
tcccttacttgtaccagctcact

SEQ ID NO: 2132 - DNA, 23 bp, Homo sapiens
cccaggaaaactccgcctttcca

SEQ ID NO: 2133 - DNA, 27 bp, Homo sapiens
tgacactgaagatcactgttctatgca

SEQ ID NO: 2134 - DNA, 23 bp, Homo sapiens
gcgtctggcacataggaggcatt

SEQ ID NO: 2135 - DNA, 24 bp, Homo sapiens
accatgctcagatcttccattcca

SEQ ID NO: 2136 - DNA, 23 bp, Homo sapiens
acaaccatgagcacctggccatt

SEQ ID NO: 2137 - DNA, 27 bp, Homo sapiens
tgaaaccataagcaagtaaaatctaca

SEQ ID NO: 2138 - DNA, 23 bp, Homo sapiens
acttcaatgcacctcctccctga

SEQ ID NO: 2139 - DNA, 24 bp, Homo sapiens
acctgacttctcactcatggctgt

SEQ ID NO: 2140 - DNA, 23 bp, Homo sapiens
cggcagtgtgggtctgatgcatt

SEQ ID NO: 2141 - DNA, 23 bp, Homo sapiens
acctactactctgggtgcctgcc

SEQ ID NO: 2142 - DNA, 23 bp, Homo sapiens
cttcctagaccctccttcgcgtc

SEQ ID NO: 2143 - DNA, 23 bp, Homo sapiens
cgcacctccctttcccgattctg

SEQ ID NO: 2144 - DNA, 23 bp, Homo sapiens
agccctgcgtttctcatcaccaa

SEQ ID NO: 2145 - DNA, 23 bp, Homo sapiens
tcgcttcgggtttcttaagggct

SEQ ID NO: 2146 - DNA, 24 bp, Homo sapiens
tcttcatgtgatagggacaatcca

SEQ ID NO: 2147 - DNA, 26 bp, Homo sapiens
acctcctcaatttacagatgtgcaca

SEQ ID NO: 2148 - DNA, 23 bp, Homo sapiens
tgctaactgctttctcacacagt

SEQ ID NO: 2149 - DNA, 23 bp, Homo sapiens
tgcccttgtttttccaaagcaaa

SEQ ID NO: 2150 - DNA, 23 bp, Homo sapiens
cctggcatgaagagttgcactgc

SEQ ID NO: 2151 - DNA, 24 bp, Homo sapiens
agactgccttggccatcaaagaca

SEQ ID NO: 2152 - DNA, 23 bp, Homo sapiens
agaatctgcaaacccatggtcaa

SEQ ID NO: 2153 - DNA, 23 bp, Homo sapiens
actgagaacaagaagaaaagcgt

SEQ ID NO: 2154 - DNA, 23 bp, Homo sapiens
gggacacctttgcttcactgcta

SEQ ID NO: 2155 - DNA, 23 bp, Homo sapiens
tttcaaggacggcagcagtaggc

SEQ ID NO: 2156 - DNA, 23 bp, Homo sapiens
actagtagctgtgggccccttgt

SEQ ID NO: 2157 - DNA, 23 bp, Homo sapiens
tgcactgaaggtgtctggcatga

SEQ ID NO: 2158 - DNA, 23 bp, Homo sapiens
gtcagtgggggatgggggaaaag

SEQ ID NO: 2159 - DNA, 23 bp, Homo sapiens
tctagagctttctggataggcca

SEQ ID NO: 2160 - DNA, 23 bp, Homo sapiens
tcccaactccagtgaaaggctca

SEQ ID NO: 2161 - DNA, 23 bp, Homo sapiens
ccactggcagccctttcttctaa

SEQ ID NO: 2162 - DNA, 24 bp, Homo sapiens
tcagtcaacattcaggttgcagct

SEQ ID NO: 2163 - DNA, 23 bp, Homo sapiens
ttcctatggccactccctgaagg

SEQ ID NO: 2164 - DNA, 27 bp, Homo sapiens
tgcacaggtattcctctttttccacca

SEQ ID NO: 2165 - DNA, 23 bp, Homo sapiens
tgagaaggcaggaatgaaggaga

SEQ ID NO: 2166 - DNA, 24 bp, Homo sapiens
tgaggaagaaagtttggccatcct

SEQ ID NO: 2167 - DNA, 23 bp, Homo sapiens
acccaggtgactcagagcaagga

SEQ ID NO: 2168 - DNA, 23 bp, Homo sapiens
cacagtggtggtgtcctctcagg

SEQ ID NO: 2169 - DNA, 23 bp, Homo sapiens
tgtaaatccctagtccaaccctt

SEQ ID NO: 2170 - DNA, 27 bp, Homo sapiens
agctctttgagtcttactctgatagca

SEQ ID NO: 2171 - DNA, 23 bp, Homo sapiens
ttctatcctgcccctccccactc

SEQ ID NO: 2172 - DNA, 23 bp, Homo sapiens
ggacagattccatgctgacagaa

SEQ ID NO: 2173 - DNA, 24 bp, Homo sapiens
agtgatggagagtgaaacttgaca

SEQ ID NO: 2174 - DNA, 23 bp, Homo sapiens
ttgcttgatcaccaactgtccca

SEQ ID NO: 2175 - DNA, 23 bp, Homo sapiens
aggcaagcctagtccaccaaaaa

SEQ ID NO: 2176 - DNA, 24 bp, Homo sapiens
tccttaggtgatgatggatgccct

SEQ ID NO: 2177 - DNA, 23 bp, Homo sapiens
tgggcactcaataagctgccagg

SEQ ID NO: 2178 - DNA, 23 bp, Homo sapiens
acccctgaacactggtgcttctg

SEQ ID NO: 2179 - DNA, 25 bp, Homo sapiens
tccatgttttagtggcccttgaggt

SEQ ID NO: 2180 - DNA, 24 bp, Homo sapiens
actgacactgcctcagaagtcaca

SEQ ID NO: 2181 - DNA, 24 bp, Homo sapiens
tggcaggtaagtgctctgagttct

SEQ ID NO: 2182 - DNA, 24 bp, Homo sapiens
accatcctgccttgcttaacaaca

SEQ ID NO: 2183 - DNA, 23 bp, Homo sapiens
cccattgctcttgagacctgcca

SEQ ID NO: 2184 - DNA, 23 bp, Homo sapiens
tccaagctcatgggcaaactcct

SEQ ID NO: 2185 - DNA, 23 bp, Homo sapiens
aagcaacttccacattcaagtga

SEQ ID NO: 2186 - DNA, 23 bp, Homo sapiens
ccacggaactccctgagcaaaca

SEQ ID NO: 2187 - DNA, 23 bp, Homo sapiens
ggtgaacagtcttgggcaggtgt

SEQ ID NO: 2188 - DNA, 23 bp, Homo sapiens
acatgcgtctctgtccttgtccc

SEQ ID NO: 2189 - DNA, 23 bp, Homo sapiens
tgcagtactaaacgcgctgctca

SEQ ID NO: 2190 - DNA, 23 bp, Homo sapiens
attacccatcccatcaccacgcc

SEQ ID NO: 2191 - DNA, 23 bp, Homo sapiens
aactcaacaagatttgcatccct

SEQ ID NO: 2192 - DNA, 23 bp, Homo sapiens
gacctcaatagcagccagagccc

SEQ ID NO: 2193 - DNA, 23 bp, Homo sapiens
acagcacccaggagacaggaaga

SEQ ID NO: 2194 - DNA, 23 bp, Homo sapiens
ttacagcaatgtgagaatggcct

SEQ ID NO: 2195 - DNA, 23 bp, Homo sapiens
caaggttgaggcccaagtcacca

SEQ ID NO: 2196 - DNA, 23 bp, Homo sapiens
gcacaccgctgaaggctacttga

SEQ ID NO: 2197 - DNA, 23 bp, Homo sapiens
acacacacactccactctgcaca

SEQ ID NO: 2198 - DNA, 23 bp, Homo sapiens
aacccaaatccccctgcagtagc

SEQ ID NO: 2199 - DNA, 25 bp, Homo sapiens
tgagacagttggcagtcttcaacca

SEQ ID NO: 2200 - DNA, 24 bp, Homo sapiens
tatgttccccatatgcactgtgca

SEQ ID NO: 2201 - DNA, 23 bp, Homo sapiens
cagtcaggttggggccgatcctg

SEQ ID NO: 2202 - DNA, 23 bp, Homo sapiens
aaccaccccaactatgctcaccc

SEQ ID NO: 2203 - DNA, 23 bp, Homo sapiens
aggctggccatcattcttgagca

SEQ ID NO: 2204 - DNA, 24 bp, Homo sapiens
tgggtttgggtaaacgagttgagt

SEQ ID NO: 2205 - DNA, 23 bp, Homo sapiens
ttgtgccatccccatgcagcata

SEQ ID NO: 2206 - DNA, 23 bp, Homo sapiens
gcctcctctctgaaactggacgc

SEQ ID NO: 2207 - DNA, 23 bp, Homo sapiens
cactgaggacaagacccaagggc

SEQ ID NO: 2208 - DNA, 23 bp, Homo sapiens
cccggcctcccagttttcatgat

SEQ ID NO: 2209 - DNA, 25 bp, Homo sapiens
agtccctgaatttgcttaaactcca

SEQ ID NO: 2210 - DNA, 26 bp, Homo sapiens
tggcacagctagggtttacatactct

SEQ ID NO: 2211 - DNA, 23 bp, Homo sapiens
tgccagtttcaagccattgacac

SEQ ID NO: 2212 - DNA, 23 bp, Homo sapiens
gtacagatggagcaggacggctg

SEQ ID NO: 2213 - DNA, 24 bp, Homo sapiens
aggggtgccagtgttaaggaaagt

SEQ ID NO: 2214 - DNA, 24 bp, Homo sapiens
agagagcttagactacctgacagt

SEQ ID NO: 2215 - DNA, 26 bp, Homo sapiens
tgggacccaatgacaaaaagagacca

SEQ ID NO: 2216 - DNA, 27 bp, Homo sapiens
agctatttcatcatgggatagttggct

SEQ ID NO: 2217 - DNA, 23 bp, Homo sapiens
tctactgaggtagcttcccccaa

SEQ ID NO: 2218 - DNA, 23 bp, Homo sapiens
tgtcctactcaagccttgtttga

SEQ ID NO: 2219 - DNA, 24 bp, Homo sapiens
cccaaggaagcagcctgtttaaca

SEQ ID NO: 2220 - DNA, 25 bp, Homo sapiens
gggtaacataatctgccatacagct

SEQ ID NO: 2221 - DNA, 24 bp, Homo sapiens
actggtttggcaaaggtaccacca

SEQ ID NO: 2222 - DNA, 23 bp, Homo sapiens
tggcacaactcacacattggctt

SEQ ID NO: 2223 - DNA, 25 bp, Homo sapiens
gcaacctcagactaacaccaggtgg

SEQ ID NO: 2224 - DNA, 26 bp, Homo sapiens
tgtgacttctacaaaagctcccagga

SEQ ID NO: 2225 - DNA, 24 bp, Homo sapiens
tcactgtgcttcaaacacaactgt

SEQ ID NO: 2226 - DNA, 23 bp, Homo sapiens
ctctggctcaacacgacctcacc

SEQ ID NO: 2227 - DNA, 23 bp, Homo sapiens
agaaaggcctttcctgacactgt

SEQ ID NO: 2228 - DNA, 23 bp, Homo sapiens
tgccaaaatgaaaagtactggga

SEQ ID NO: 2229 - DNA, 23 bp, Homo sapiens
tgtgtggcagactagtgacagca

SEQ ID NO: 2230 - DNA, 25 bp, Homo sapiens
ggcaaacctcaggaaaaagttggca

SEQ ID NO: 2231 - DNA, 25 bp, Homo sapiens
acttcccaaagctgaatgaccatca

SEQ ID NO: 2232 - DNA, 23 bp, Homo sapiens
actgtgatctcagtagaatcact

SEQ ID NO: 2233 - DNA, 23 bp, Homo sapiens
tggaagggtggaaggtacaagga

SEQ ID NO: 2234 - DNA, 27 bp, Homo sapiens
tgagtgttttgcttaaagagacaggga

SEQ ID NO: 2235 - DNA, 23 bp, Homo sapiens
attcttccccaaagccaatacat

SEQ ID NO: 2236 - DNA, 23 bp, Homo sapiens
gcccactgcataaacttaggcca

SEQ ID NO: 2237 - DNA, 23 bp, Homo sapiens
ttcccctgtaaccaagttcaaat

SEQ ID NO: 2238 - DNA, 25 bp, Homo sapiens
tcaatgtgaacttataaatctgagt

SEQ ID NO: 2239 - DNA, 23 bp, Homo sapiens
gcagacagcactcatcatgcatt

SEQ ID NO: 2240 - DNA, 26 bp, Homo sapiens
agcttcatccctaaccatttctgaga

SEQ ID NO: 2241 - DNA, 23 bp, Homo sapiens
acagcaaggggaaatggcctgag

SEQ ID NO: 2242 - DNA, 24 bp, Homo sapiens
tcaattttctctagaggctaggca

SEQ ID NO: 2243 - DNA, 23 bp, Homo sapiens
gccccagaactttggacccaagt

SEQ ID NO: 2244 - DNA, 23 bp, Homo sapiens
cacatgatggtgccagtggaact

SEQ ID NO: 2245 - DNA, 25 bp, Homo sapiens
tcaagcagtgatatcagattccaca

SEQ ID NO: 2246 - DNA, 23 bp, Homo sapiens
tgtcaagggccaccagcaattct

SEQ ID NO: 2247 - DNA, 23 bp, Homo sapiens
tcctctgtctcccactcccttga

SEQ ID NO: 2248 - DNA, 23 bp, Homo sapiens
ggtgccagtgactaggtgtgcaa

SEQ ID NO: 2249 - DNA, 23 bp, Homo sapiens
aggccttctcctcactgaatgct

SEQ ID NO: 2250 - DNA, 23 bp, Homo sapiens
aaagagaacatggccgtgacccc

SEQ ID NO: 2251 - DNA, 23 bp, Homo sapiens
gagtttgtaggcaggggcaggtc

SEQ ID NO: 2252 - DNA, 22 bp, Homo sapiens
tccgtcagacccaggagtccag

SEQ ID NO: 2253 - DNA, 23 bp, Homo sapiens
actctgtcctccctgctcaaact

SEQ ID NO: 2254 - DNA, 23 bp, Homo sapiens
aagcagcccccatgaactctcag

SEQ ID NO: 2255 - DNA, 23 bp, Homo sapiens
ttgtcctcattgtcccccgcatc

SEQ ID NO: 2256 - DNA, 26 bp, Homo sapiens
agccatgtagttttctttgcatagca

SEQ ID NO: 2257 - DNA, 27 bp, Homo sapiens
acaccaaagaaatatgactagccctca

SEQ ID NO: 2258 - DNA, 25 bp, Homo sapiens
tcctaaaggaagctggatgaagtca

SEQ ID NO: 2259 - DNA, 24 bp, Homo sapiens
aggttatttaaaagcaatacccgt

SEQ ID NO: 2260 - DNA, 23 bp, Homo sapiens
actcctccacttatccccaccgc

SEQ ID NO: 2261 - DNA, 24 bp, Homo sapiens
actctcctccacaaaatgaaaaca

SEQ ID NO: 2262 - DNA, 23 bp, Homo sapiens
tagacgaacagctgcagagagcc

SEQ ID NO: 2263 - DNA, 23 bp, Homo sapiens
agagttacatgaaaagggtttcc

SEQ ID NO: 2264 - DNA, 23 bp, Homo sapiens
agtgctacattgatggtcacact

SEQ ID NO: 2265 - DNA, 26 bp, Homo sapiens
tcttcaactttataaaattctccact

SEQ ID NO: 2266 - DNA, 25 bp, Homo sapiens
acagttctttctgttgtttgtcgct

SEQ ID NO: 2267 - DNA, 23 bp, Homo sapiens
agccccttgaaaaatatcgcaaa

SEQ ID NO: 2268 - DNA, 23 bp, Homo sapiens
agacttaatgacacagcagccat

SEQ ID NO: 2269 - DNA, 23 bp, Homo sapiens
tgaagtattgtgtgacacagttt

SEQ ID NO: 2270 - DNA, 23 bp, Homo sapiens
gagaactctgtgaccccatggcc

SEQ ID NO: 2271 - DNA, 23 bp, Homo sapiens
ctcctgcacccagagagaaaggc

SEQ ID NO: 2272 - DNA, 23 bp, Homo sapiens
gccatagctgtggggaaggacag

SEQ ID NO: 2273 - DNA, 23 bp, Homo sapiens
tcccacaaagacccctgacctca

SEQ ID NO: 2274 - DNA, 24 bp, Homo sapiens
ccacagtaagtgccactgaggtca

SEQ ID NO: 2275 - DNA, 23 bp, Homo sapiens
gccgtgactcagaatggcactga

SEQ ID NO: 2276 - DNA, 23 bp, Homo sapiens
aggtcagtgatgaggagcgggta

SEQ ID NO: 2277 - DNA, 26 bp, Homo sapiens
tgcccatagtacaataatacacagct

SEQ ID NO: 2278 - DNA, 23 bp, Homo sapiens
agcttgcaggcaccatatacggg

SEQ ID NO: 2279 - DNA, 22 bp, Homo sapiens
cttctgatggccaggtggggac

SEQ ID NO: 2280 - DNA, 23 bp, Homo sapiens
tgccacttttgacctgcaccaga

SEQ ID NO: 2281 - DNA, 23 bp, Homo sapiens
cccccgggtcttgcaagattctt

SEQ ID NO: 2282 - DNA, 23 bp, Homo sapiens
gtcccggactccatcctttcagc

SEQ ID NO: 2283 - DNA, 23 bp, Homo sapiens
tatggtggctggaaggtgcatcg

SEQ ID NO: 2284 - DNA, 18 bp, Homo sapiens
gcccggacgccaaagccc

SEQ ID NO: 2285 - DNA, 23 bp, Homo sapiens
aggccacatcatcacgacatggg

SEQ ID NO: 2286 - DNA, 22 bp, Homo sapiens
gctcaagccatcctcccatgcc

SEQ ID NO: 2287 - DNA, 23 bp, Homo sapiens
tcctagtgtctgtgccctgtccc

SEQ ID NO: 2288 - DNA, 23 bp, Homo sapiens
ccactgcaactgcctgagcctta

SEQ ID NO: 2289 - DNA, 23 bp, Homo sapiens
cttcctggctcccactcctaggt

SEQ ID NO: 2290 - DNA, 23 bp, Homo sapiens
agtgccaggtaccctccagagag

SEQ ID NO: 2291 - DNA, 23 bp, Homo sapiens
agcactcacacatcctgtccagc

SEQ ID NO: 2292 - DNA, 23 bp, Homo sapiens
ggtttgaggtaggggaggccttg

SEQ ID NO: 2293 - DNA, 23 bp, Homo sapiens
cgctcaggcctggctgattctat

SEQ ID NO: 2294 - DNA, 20 bp, Homo sapiens
gacaggcggcggcgggctag

SEQ ID NO: 2295 - DNA, 23 bp, Homo sapiens
tcctggctcctccaatcaggtca

SEQ ID NO: 2296 - DNA, 23 bp, Homo sapiens
ccaaggatgctgagctggacagg

SEQ ID NO: 2297 - DNA, 23 bp, Homo sapiens
cgagcccaacctgcagtcaatga

SEQ ID NO: 2298 - DNA, 23 bp, Homo sapiens
gcctccaggatagagcaccctgg

SEQ ID NO: 2299 - DNA, 23 bp, Homo sapiens
ggatattgaaggggtgggcctgg

SEQ ID NO: 2300 - DNA, 23 bp, Homo sapiens
gccgtagtgctcctgtaagaggc

SEQ ID NO: 2301 - DNA, 23 bp, Homo sapiens
cctagggtaggggagcggttctg

SEQ ID NO: 2302 - DNA, 23 bp, Homo sapiens
ctccctctctcctgggtctcacc

SEQ ID NO: 2303 - DNA, 23 bp, Homo sapiens
gactggacaggctacaagggagt

SEQ ID NO: 2304 - DNA, 23 bp, Homo sapiens
tgggtggtgacgggagaaaagat

SEQ ID NO: 2305 - DNA, 21 bp, Homo sapiens
agaaacccactggagcccctg

SEQ ID NO: 2306 - DNA, 25 bp, Homo sapiens
aggaagtcatcaaggtgacatagga

SEQ ID NO: 2307 - DNA, 23 bp, Homo sapiens
cccaggagcccagaaatggtgtt

SEQ ID NO: 2308 - DNA, 23 bp, Homo sapiens
gcatttcgtagccaaccatgaat

SEQ ID NO: 2309 - DNA, 23 bp, Homo sapiens
atatgaaatatgaatgccacagg

SEQ ID NO: 2310 - DNA, 23 bp, Homo sapiens
tttgttcagaaatttggggtaga

SEQ ID NO: 2311 - DNA, 23 bp, Homo sapiens
acccctcctgcatttgctgttct

SEQ ID NO: 2312 - DNA, 23 bp, Homo sapiens
gtcagctgcagcagacggagttg

SEQ ID NO: 2313 - DNA, 23 bp, Homo sapiens
ctaatggtgggaggctctgcacc

SEQ ID NO: 2314 - DNA, 23 bp, Homo sapiens
agttcctccctccttccctccac

SEQ ID NO: 2315 - DNA, 23 bp, Homo sapiens
catctgtggtcagctgctcctcc

SEQ ID NO: 2316 - DNA, 23 bp, Homo sapiens
ctacctttgatggtggggcccag

SEQ ID NO: 2317 - DNA, 23 bp, Homo sapiens
tggccagggatcagatctccagg

SEQ ID NO: 2318 - DNA, 23 bp, Homo sapiens
gcatccccttctccagcaggaag

SEQ ID NO: 2319 - DNA, 23 bp, Homo sapiens
ccaacacccattcccaaagtggc

SEQ ID NO: 2320 - DNA, 23 bp, Homo sapiens
cccccagagaatctcactgcagc

SEQ ID NO: 2321 - DNA, 23 bp, Homo sapiens
caaggactggggatcctggcatc

SEQ ID NO: 2322 - DNA, 22 bp, Homo sapiens
gaggcctcagtgagccctctga

SEQ ID NO: 2323 - DNA, 23 bp, Homo sapiens
cagctcgttatcctcctcgctgc

SEQ ID NO: 2324 - DNA, 23 bp, Homo sapiens
ggcaactccggaaacttcctgga

SEQ ID NO: 2325 - DNA, 24 bp, Homo sapiens
aggcttatcctgagagccttctgc

SEQ ID NO: 2326 - DNA, 23 bp, Homo sapiens
aggtgggctgagacttccaggat

SEQ ID NO: 2327 - DNA, 23 bp, Homo sapiens
actttttgtgtaggaaaaatgtt

SEQ ID NO: 2328 - DNA, 23 bp, Homo sapiens
tgtgtggcatcacctggtgctac

SEQ ID NO: 2329 - DNA, 23 bp, Homo sapiens
atctggcagtggttttgtgcacg

SEQ ID NO: 2330 - DNA, 23 bp, Homo sapiens
aatgtgcctttttaactcacagt

SEQ ID NO: 2331 - DNA, 23 bp, Homo sapiens
tgcgtggaagctatggttctgca

SEQ ID NO: 2332 - DNA, 27 bp, Homo sapiens
agggtaatgggatgaatttgaagagca

SEQ ID NO: 2333 - DNA, 23 bp, Homo sapiens
actgaaaagaccacagtgttgca

SEQ ID NO: 2334 - DNA, 23 bp, Homo sapiens
ctaccagtgtcacacttgggccc

SEQ ID NO: 2335 - DNA, 23 bp, Homo sapiens
ttgggagtgaacttcagcctggc

SEQ ID NO: 2336 - DNA, 23 bp, Homo sapiens
agagacgtgggattggggtagct

SEQ ID NO: 2337 - DNA, 23 bp, Homo sapiens
ggggtgggggagggataggatag

SEQ ID NO: 2338 - DNA, 23 bp, Homo sapiens
accttctagccatgctctcccca

SEQ ID NO: 2339 - DNA, 23 bp, Homo sapiens
tggctgacgtttgcattctgggt

SEQ ID NO: 2340 - DNA, 23 bp, Homo sapiens
gcagaaagaggcaggcaggttct

SEQ ID NO: 2341 - DNA, 23 bp, Homo sapiens
agtggtcaggtcgtgggtctgag

SEQ ID NO: 2342 - DNA, 23 bp, Homo sapiens
cccagcccctacaagtgcactac

SEQ ID NO: 2343 - DNA, 23 bp, Homo sapiens
ccccaaggtctgcagcatctctc

SEQ ID NO: 2344 - DNA, 23 bp, Homo sapiens
aaggcacgaatttgcttccacgc

SEQ ID NO: 2345 - DNA, 23 bp, Homo sapiens
accaaatatcccaccttcccgcg

SEQ ID NO: 2346 - DNA, 23 bp, Homo sapiens
agtctgcagtatccggtccccat

SEQ ID NO: 2347 - DNA, 23 bp, Homo sapiens
cttgcccatgtcagaaaagcgca

SEQ ID NO: 2348 - DNA, 23 bp, Homo sapiens
gaggttgccaagaaccctgagct

SEQ ID NO: 2349 - DNA, 23 bp, Homo sapiens
ggacagcttccacaaccacatca

SEQ ID NO: 2350 - DNA, 23 bp, Homo sapiens
tcccccactctgttccctatggg

SEQ ID NO: 2351 - DNA, 23 bp, Homo sapiens
gcaactggcacatgtggaagcag

SEQ ID NO: 2352 - DNA, 23 bp, Homo sapiens
gctctgagactgcaaggggacag

SEQ ID NO: 2353 - DNA, 23 bp, Homo sapiens
tccccaaccccaaccaaaatccg

SEQ ID NO: 2354 - DNA, 26 bp, Homo sapiens
gcccagaagaaagtgagaggtaaggc

SEQ ID NO: 2355 - DNA, 23 bp, Homo sapiens
caagttgggatacgcctccacgg

SEQ ID NO: 2356 - DNA, 24 bp, Homo sapiens
actgactcaacatggcccagttga

SEQ ID NO: 2357 - DNA, 23 bp, Homo sapiens
aagacaatgagccttctacacca

SEQ ID NO: 2358 - DNA, 23 bp, Homo sapiens
ttttcctcgtttctcacttgact

SEQ ID NO: 2359 - DNA, 23 bp, Homo sapiens
cgcagtacaggctgagacagacc

SEQ ID NO: 2360 - DNA, 23 bp, Homo sapiens
cagctcttcacacccggtgtctc

SEQ ID NO: 2361 - DNA, 23 bp, Homo sapiens
acgggcagaaagactccatctgc

SEQ ID NO: 2362 - DNA, 23 bp, Homo sapiens
gcacctgcaccgtatagtccagg

SEQ ID NO: 2363 - DNA, 23 bp, Homo sapiens
gtaacagaggccccagcaaccat

SEQ ID NO: 2364 - DNA, 23 bp, Homo sapiens
gcagcatgggagcctgatccttc

SEQ ID NO: 2365 - DNA, 23 bp, Homo sapiens
tgtttgctccaaggcaccaaggg

SEQ ID NO: 2366 - DNA, 21 bp, Homo sapiens
cgccagagcttccacctcagg

SEQ ID NO: 2367 - DNA, 27 bp, Homo sapiens
tccttttagtaccacataacatcctga

SEQ ID NO: 2368 - DNA, 23 bp, Homo sapiens
tcaacctcaaatcccacccaaca

SEQ ID NO: 2369 - DNA, 23 bp, Homo sapiens
agttcaaaaggtgggagggtggc

SEQ ID NO: 2370 - DNA, 23 bp, Homo sapiens
ggcagggctggtgtaacacagaa

SEQ ID NO: 2371 - DNA, 23 bp, Homo sapiens
cagctggtgtcctgagctccatt

SEQ ID NO: 2372 - DNA, 23 bp, Homo sapiens
cccgacccctcctagagacactg

SEQ ID NO: 2373 - DNA, 23 bp, Homo sapiens
ttcaaagctacgcaccactgagg

SEQ ID NO: 2374 - DNA, 21 bp, Homo sapiens
agctgggactgtgggtgcatg

SEQ ID NO: 2375 - DNA, 24 bp, Homo sapiens
tgctcaggaaagaagttgagggca

SEQ ID NO: 2376 - DNA, 24 bp, Homo sapiens
aggaaaaaggaatccgtgatggca

SEQ ID NO: 2377 - DNA, 27 bp, Homo sapiens
agcaatcatgagtttcctatagctcct

SEQ ID NO: 2378 - DNA, 23 bp, Homo sapiens
ccagtgtttaggaaccacccgca

SEQ ID NO: 2379 - DNA, 23 bp, Homo sapiens
ccttcaaggtctgggatggctgg

SEQ ID NO: 2380 - DNA, 23 bp, Homo sapiens
actgaaggagtggaagatgccgc

SEQ ID NO: 2381 - DNA, 23 bp, Homo sapiens
cgccagtgataagggctctgtgt

SEQ ID NO: 2382 - DNA, 23 bp, Homo sapiens
tccacttggaaagcaccatgcca

SEQ ID NO: 2383 - DNA, 23 bp, Homo sapiens
tgaggcctgctcactggtagaac

SEQ ID NO: 2384 - DNA, 23 bp, Homo sapiens
tgtgtttggctgggtgcagaact

SEQ ID NO: 2385 - DNA, 23 bp, Homo sapiens
caggagttctgcccggaggtctg

SEQ ID NO: 2386 - DNA, 23 bp, Homo sapiens
actggctcccttggcaatctgtc

SEQ ID NO: 2387 - DNA, 21 bp, Homo sapiens
cctgtgtcactgtgcccagca

SEQ ID NO: 2388 - DNA, 23 bp, Homo sapiens
aggcaaagcagtagcctaagggt

SEQ ID NO: 2389 - DNA, 26 bp, Homo sapiens
agtctgtcactgatcctgtacactca

SEQ ID NO: 2390 - DNA, 23 bp, Homo sapiens
taaggtctgactctgagatgtgc

SEQ ID NO: 2391 - DNA, 23 bp, Homo sapiens
acatctcctacctaaggctgact

SEQ ID NO: 2392 - DNA, 23 bp, Homo sapiens
acagcttgctatgcccttccctt

SEQ ID NO: 2393 - DNA, 23 bp, Homo sapiens
tttgtggcagaatggtggctgga

SEQ ID NO: 2394 - DNA, 23 bp, Homo sapiens
aaccaattatgaactcagggctt

SEQ ID NO: 2395 - DNA, 23 bp, Homo sapiens
aaccatgccttgctctctcccac

SEQ ID NO: 2396 - DNA, 23 bp, Homo sapiens
tgtcagaatgcaaggaacaaaaa

SEQ ID NO: 2397 - DNA, 23 bp, Homo sapiens
ctgttatccctccccactcccca

SEQ ID NO: 2398 - DNA, 24 bp, Homo sapiens
acctctttcccaactgcaaaccct

SEQ ID NO: 2399 - DNA, 23 bp, Homo sapiens
tactgtacctggggcagctcgta

SEQ ID NO: 2400 - DNA, 23 bp, Homo sapiens
ggaacctccatgactccagcagg

SEQ ID NO: 2401 - DNA, 23 bp, Homo sapiens
tcccacagccccctctatttctt

SEQ ID NO: 2402 - DNA, 23 bp, Homo sapiens
ggacagctctgttggaagcaagc

SEQ ID NO: 2403 - DNA, 24 bp, Homo sapiens
ggctaagacactgttaggcctgca

SEQ ID NO: 2404 - DNA, 25 bp, Homo sapiens
agagacaatgtcctaaaccagctca

SEQ ID NO: 2405 - DNA, 23 bp, Homo sapiens
ttaacatgtactgtctgtttcca

SEQ ID NO: 2406 - DNA, 23 bp, Homo sapiens
ctgcagtgggatgccctgcaaac

SEQ ID NO: 2407 - DNA, 26 bp, Homo sapiens
gtgctcagatcttaaaaggacactct

SEQ ID NO: 2408 - DNA, 23 bp, Homo sapiens
tggaatgttctcggcagacgcaa

SEQ ID NO: 2409 - DNA, 23 bp, Homo sapiens
tgaagacaggcccaacaccttcc

SEQ ID NO: 2410 - DNA, 23 bp, Homo sapiens
tccctcgcaaaaatacccacaga

SEQ ID NO: 2411 - DNA, 23 bp, Homo sapiens
aactctactagttggccctctct

SEQ ID NO: 2412 - DNA, 23 bp, Homo sapiens
acaactctatcccctccccgtct

SEQ ID NO: 2413 - DNA, 23 bp, Homo sapiens
tccccaaattggaaagcccggaa

SEQ ID NO: 2414 - DNA, 23 bp, Homo sapiens
actttgctgccagctgtgcaaag

SEQ ID NO: 2415 - DNA, 23 bp, Homo sapiens
ctttggtggttcccgtggtcaca

SEQ ID NO: 2416 - DNA, 26 bp, Homo sapiens
aggagttgaaaagaatgaagatgagc

SEQ ID NO: 2417 - DNA, 18 bp, Homo sapiens
cctgtgggagggctttcc

SEQ ID NO: 2418 - DNA, 23 bp, Homo sapiens
ttgaggggaaaagggagggtcca

SEQ ID NO: 2419 - DNA, 23 bp, Homo sapiens
gtctgtccctgtttggcctcctc

SEQ ID NO: 2420 - DNA, 23 bp, Homo sapiens
gccaggggcttggaaacctatgt

SEQ ID NO: 2421 - DNA, 23 bp, Homo sapiens
tctctaaagaagtggataatcaa

SEQ ID NO: 2422 - DNA, 25 bp, Homo sapiens
tcctaggatttcttctgaccacact

SEQ ID NO: 2423 - DNA, 23 bp, Homo sapiens
cagaggacatcagggttgtggcc

SEQ ID NO: 2424 - DNA, 23 bp, Homo sapiens
cgtgacctttgggagaatgggca

SEQ ID NO: 2425 - DNA, 23 bp, Homo sapiens
cccacacgtcctcaggcattcaa

SEQ ID NO: 2426 - DNA, 23 bp, Homo sapiens
acccgccctctcaattttgcaga

SEQ ID NO: 2427 - DNA, 23 bp, Homo sapiens
cccctccgggctgagacaatatt

SEQ ID NO: 2428 - DNA, 23 bp, Homo sapiens
gggaagttgggcgagttccagaa

SEQ ID NO: 2429 - DNA, 23 bp, Homo sapiens
gcactactgccttatgcgcaaca

SEQ ID NO: 2430 - DNA, 23 bp, Homo sapiens
tgagggtgaggttgagtccagct

SEQ ID NO: 2431 - DNA, 23 bp, Homo sapiens
ttgcagcagggttcatgagggtc

SEQ ID NO: 2432 - DNA, 19 bp, Homo sapiens
ggttgggggctgtcctggg

SEQ ID NO: 2433 - DNA, 23 bp, Homo sapiens
caccaggtgatcgcccatctctg

SEQ ID NO: 2434 - DNA, 23 bp, Homo sapiens
tgtgatgtggcatctgggcttgt

SEQ ID NO: 2435 - DNA, 23 bp, Homo sapiens
tacgggggacagacttgagggac

SEQ ID NO: 2436 - DNA, 22 bp, Homo sapiens
ctttccacccacctctgccctg

SEQ ID NO: 2437 - DNA, 23 bp, Homo sapiens
cgtgaggacccgtcatcttcacg

SEQ ID NO: 2438 - DNA, 23 bp, Homo sapiens
attcggacagggaagggggttct

SEQ ID NO: 2439 - DNA, 23 bp, Homo sapiens
ggagatggccatggcacttacca

SEQ ID NO: 2440 - DNA, 23 bp, Homo sapiens
acagacagacagacagatgcgcc

SEQ ID NO: 2441 - DNA, 23 bp, Homo sapiens
ttggtgacctcatgcacaccctg

SEQ ID NO: 2442 - DNA, 23 bp, Homo sapiens
aggcggatcacattgaaggtgcc

SEQ ID NO: 2443 - DNA, 23 bp, Homo sapiens
cccggatacctatgggagccaga

SEQ ID NO: 2444 - DNA, 23 bp, Homo sapiens
ctgctgctgcttaggtggtggat

SEQ ID NO: 2445 - DNA, 23 bp, Homo sapiens
ccaaccctgtcacagccttcaca

SEQ ID NO: 2446 - DNA, 26 bp, Homo sapiens
gcccagttgaagagtacatgtcagca

SEQ ID NO: 2447 - DNA, 23 bp, Homo sapiens
acagcaagtctcagcagctggtc

SEQ ID NO: 2448 - DNA, 21 bp, Homo sapiens
cacaggccccaggagtgaggg

SEQ ID NO: 2449 - DNA, 23 bp, Homo sapiens
tgggaaagccgccacatctctac

SEQ ID NO: 2450 - DNA, 23 bp, Homo sapiens
gcctggccaagcaagcatatgtg

SEQ ID NO: 2451 - DNA, 23 bp, Homo sapiens
tgcagatatgcccagggagaagg

SEQ ID NO: 2452 - DNA, 23 bp, Homo sapiens
atggatgggtatcgtggtgcagc

SEQ ID NO: 2453 - DNA, 23 bp, Homo sapiens
aggggaaagatgaggacacccca

SEQ ID NO: 2454 - DNA, 23 bp, Homo sapiens
gtcagaggactggacccgaggtc

SEQ ID NO: 2455 - DNA, 23 bp, Homo sapiens
gctgaagagcgacaggagagctc

SEQ ID NO: 2456 - DNA, 23 bp, Homo sapiens
aggttccccagctgcttccaaaa

SEQ ID NO: 2457 - DNA, 23 bp, Homo sapiens
tgggctgacaatcaatgggtgct

SEQ ID NO: 2458 - DNA, 23 bp, Homo sapiens
acagaaagcaggtctgactggcc

SEQ ID NO: 2459 - DNA, 23 bp, Homo sapiens
aatcaggacgtcagcatcagggc

SEQ ID NO: 2460 - DNA, 23 bp, Homo sapiens
cagaagtgacccatctgccctgg

SEQ ID NO: 2461 - DNA, 23 bp, Homo sapiens
cagctcacagcctagccacatgt

SEQ ID NO: 2462 - DNA, 23 bp, Homo sapiens
gacagagcccagcttccctcaag

SEQ ID NO: 2463 - DNA, 25 bp, Homo sapiens
acagcctacactaatggcattcagc

SEQ ID NO: 2464 - DNA, 26 bp, Homo sapiens
tgcaacaggatgtcagaatgtttgct

SEQ ID NO: 2465 - DNA, 23 bp, Homo sapiens
tgtcaacatgaagtgaaaaggct

SEQ ID NO: 2466 - DNA, 23 bp, Homo sapiens
gtagcttagcaccatgggaccca

SEQ ID NO: 2467 - DNA, 25 bp, Homo sapiens
acacagcaaaatgccaggaaattct

SEQ ID NO: 2468 - DNA, 23 bp, Homo sapiens
ggaaggtcaaatcacgcgtggga

SEQ ID NO: 2469 - DNA, 23 bp, Homo sapiens
ttccctcacaaagccagtagtct

SEQ ID NO: 2470 - DNA, 23 bp, Homo sapiens
ctcccttcctcccccagtccaaa

SEQ ID NO: 2471 - DNA, 23 bp, Homo sapiens
acaacttcactttcccgccgact

SEQ ID NO: 2472 - DNA, 23 bp, Homo sapiens
tatcggactgccaagtgtgccag

SEQ ID NO: 2473 - DNA, 23 bp, Homo sapiens
ttggttagcagtccaaataggga

SEQ ID NO: 2474 - DNA, 23 bp, Homo sapiens
ttctttcctaaactaaggcctct

SEQ ID NO: 2475 - DNA, 23 bp, Homo sapiens
aagggaggtgaactctgcttgca

SEQ ID NO: 2476 - DNA, 23 bp, Homo sapiens
tcaggaaatataaactactatgt

SEQ ID NO: 2477 - DNA, 26 bp, Homo sapiens
aggcaattttaactcaattatcccca

SEQ ID NO: 2478 - DNA, 23 bp, Homo sapiens
tggggttgacaatgtctaagtca

SEQ ID NO: 2479 - DNA, 23 bp, Homo sapiens
aaacttggggaagagtgacagca

SEQ ID NO: 2480 - DNA, 23 bp, Homo sapiens
cgttttccagtcagtccaagaca

SEQ ID NO: 2481 - DNA, 23 bp, Homo sapiens
tggaactgaggagtatggctcgt

SEQ ID NO: 2482 - DNA, 23 bp, Homo sapiens
tgacccctggaacctgacagaca

SEQ ID NO: 2483 - DNA, 23 bp, Homo sapiens
tttcccagccagctcaacacaca

SEQ ID NO: 2484 - DNA, 23 bp, Homo sapiens
aaagcttctgtctagggctctcc

SEQ ID NO: 2485 - DNA, 23 bp, Homo sapiens
tcagctgaccccctccaagctat

SEQ ID NO: 2486 - DNA, 23 bp, Homo sapiens
atgcagctgagcggtctaccttg

SEQ ID NO: 2487 - DNA, 23 bp, Homo sapiens
ccctaggttttcagagccctggc

SEQ ID NO: 2488 - DNA, 23 bp, Homo sapiens
gcctcccagttgctcagagatgg

SEQ ID NO: 2489 - DNA, 23 bp, Homo sapiens
actcttgacgggggtgccttttc

SEQ ID NO: 2490 - DNA, 27 bp, Homo sapiens
tgctagacagttctgtaagactcaggg

SEQ ID NO: 2491 - DNA, 23 bp, Homo sapiens
acacatcaaggtcactggcacgg

SEQ ID NO: 2492 - DNA, 25 bp, Homo sapiens
ggagaaaagagaggtcagtgtgcca

SEQ ID NO: 2493 - DNA, 26 bp, Homo sapiens
accatcaactctactacccagagcca

SEQ ID NO: 2494 - DNA, 23 bp, Homo sapiens
acaggcacacactttaggggctt

SEQ ID NO: 2495 - DNA, 23 bp, Homo sapiens
acagttttctcccatgccccagg

SEQ ID NO: 2496 - DNA, 23 bp, Homo sapiens
tgcctgccttcaaaaacagcagt

SEQ ID NO: 2497 - DNA, 23 bp, Homo sapiens
ttgctcccaaagtcctcatagca

SEQ ID NO: 2498 - DNA, 24 bp, Homo sapiens
cccccttcctaaaagagactacct

SEQ ID NO: 2499 - DNA, 23 bp, Homo sapiens
aagtgcctggggttttcctaccg

SEQ ID NO: 2500 - DNA, 25 bp, Homo sapiens
acacttccagtctgaagcaaaatca

SEQ ID NO: 2501 - DNA, 25 bp, Homo sapiens
tgttcccaagaattagcagtgagca

SEQ ID NO: 2502 - DNA, 24 bp, Homo sapiens
actggctgagaaatgagatgggac

SEQ ID NO: 2503 - DNA, 23 bp, Homo sapiens
atttcaactgaccttcatacagt

SEQ ID NO: 2504 - DNA, 23 bp, Homo sapiens
aataaggccaacccacctcggtg

SEQ ID NO: 2505 - DNA, 24 bp, Homo sapiens
acaggacagaactgggaaacttgt

SEQ ID NO: 2506 - DNA, 23 bp, Homo sapiens
tgaccctgttgtgtctaccccca

SEQ ID NO: 2507 - DNA, 23 bp, Homo sapiens
aagttgtgtttctcttgccttct

SEQ ID NO: 2508 - DNA, 23 bp, Homo sapiens
gtcccccactcccctctttcagt

SEQ ID NO: 2509 - DNA, 23 bp, Homo sapiens
aagacccactagcaatgctgggg

SEQ ID NO: 2510 - DNA, 21 bp, Homo sapiens
caacacatttttcaagtatgt

SEQ ID NO: 2511 - DNA, 23 bp, Homo sapiens
attgttatccagaaaaacaaaaa

SEQ ID NO: 2512 - DNA, 23 bp, Homo sapiens
cgcacacagtgttctggttgctg

SEQ ID NO: 2513 - DNA, 28 bp, Homo sapiens
tggcattaaatttcatttcacccctcca

SEQ ID NO: 2514 - DNA, 23 bp, Homo sapiens
tggccacaaagaaagtaccccaa

SEQ ID NO: 2515 - DNA, 23 bp, Homo sapiens
agctgttcctctgactgccatct

SEQ ID NO: 2516 - DNA, 23 bp, Homo sapiens
cagattacagaacttttcatact

SEQ ID NO: 2517 - DNA, 23 bp, Homo sapiens
ccggacaagagagcagcagttgt

SEQ ID NO: 2518 - DNA, 27 bp, Homo sapiens
aggacatcttaagtaaaggcataagct

SEQ ID NO: 2519 - DNA, 23 bp, Homo sapiens
acactctgagtcagtacttggct

SEQ ID NO: 2520 - DNA, 26 bp, Homo sapiens
atataaatagcatacaaatcgcatgc

SEQ ID NO: 2521 - DNA, 24 bp, Homo sapiens
acagttcttgtttactttccccca

SEQ ID NO: 2522 - DNA, 25 bp, Homo sapiens
actttcaagccatcccagagtacct

SEQ ID NO: 2523 - DNA, 23 bp, Homo sapiens
aatttccatcgaccaacgttctt

SEQ ID NO: 2524 - DNA, 24 bp, Homo sapiens
cctgtctctccagtccttcttggc

SEQ ID NO: 2525 - DNA, 23 bp, Homo sapiens
acctctcggacatcaaagctcct

SEQ ID NO: 2526 - DNA, 23 bp, Homo sapiens
actctcccgcccacatactggaa

SEQ ID NO: 2527 - DNA, 23 bp, Homo sapiens
agagagatttaaaataccaggca

SEQ ID NO: 2528 - DNA, 26 bp, Homo sapiens
acatgatggaagcagtgaaggactca

SEQ ID NO: 2529 - DNA, 23 bp, Homo sapiens
tccatccatcacacacataccct

SEQ ID NO: 2530 - DNA, 19 bp, Homo sapiens
ccacctggccgtggtccac

SEQ ID NO: 2531 - DNA, 23 bp, Homo sapiens
ttggagggggcaagtgaggacta

SEQ ID NO: 2532 - DNA, 23 bp, Homo sapiens
ttggtgccctttcgtcttcctcc

SEQ ID NO: 2533 - DNA, 23 bp, Homo sapiens
gcccatcttgtcccgaattgacc

SEQ ID NO: 2534 - DNA, 23 bp, Homo sapiens
ctgtgtccctcatggcacctgac

SEQ ID NO: 2535 - DNA, 24 bp, Homo sapiens
tgctgttcttttgaaactgggcca

SEQ ID NO: 2536 - DNA, 21 bp, Homo sapiens
cccctgggatggcaatggcag

SEQ ID NO: 2537 - DNA, 24 bp, Homo sapiens
gccctttgcccttggattaaacca

SEQ ID NO: 2538 - DNA, 23 bp, Homo sapiens
tcgccattcgattgcaaactatt

SEQ ID NO: 2539 - DNA, 23 bp, Homo sapiens
gaaagcccccagacctctgcaat

SEQ ID NO: 2540 - DNA, 25 bp, Homo sapiens
tcttggagggtaaagattataacct

SEQ ID NO: 2541 - DNA, 26 bp, Homo sapiens
tgcctttgattcaggtattttagcca

SEQ ID NO: 2542 - DNA, 24 bp, Homo sapiens
tgactacacactccgtctttgtca

SEQ ID NO: 2543 - DNA, 25 bp, Homo sapiens
gcatgggtcacaaacaaagaagaca

SEQ ID NO: 2544 - DNA, 23 bp, Homo sapiens
gtgacgtcagaacagcgtggaga

SEQ ID NO: 2545 - DNA, 25 bp, Homo sapiens
ttaaagtggctgcaaagaatttgga

SEQ ID NO: 2546 - DNA, 23 bp, Homo sapiens
tgcgagaactggccttttctccc

SEQ ID NO: 2547 - DNA, 27 bp, Homo sapiens
agagatcctcctacctcagtttcctga

SEQ ID NO: 2548 - DNA, 23 bp, Homo sapiens
gagccaaggagcagagggaactg

SEQ ID NO: 2549 - DNA, 23 bp, Homo sapiens
tgtctgtcactgaacctgcctgc

SEQ ID NO: 2550 - DNA, 20 bp, Homo sapiens
ctcctgcccgctgtgcagag

SEQ ID NO: 2551 - DNA, 23 bp, Homo sapiens
gcctcggctttcagagaggaacc

SEQ ID NO: 2552 - DNA, 23 bp, Homo sapiens
gcacagctccttctcattgcagc

SEQ ID NO: 2553 - DNA, 27 bp, Homo sapiens
tcactcagtatactaacctcagtggca

SEQ ID NO: 2554 - DNA, 23 bp, Homo sapiens
tttcgccctagaacagcaggagg

SEQ ID NO: 2555 - DNA, 23 bp, Homo sapiens
tggaggaactggaggcagctgta

SEQ ID NO: 2556 - DNA, 23 bp, Homo sapiens
actgctgtgccccctgtatccta

SEQ ID NO: 2557 - DNA, 25 bp, Homo sapiens
ggccaaacctaacttccttgagcct

SEQ ID NO: 2558 - DNA, 22 bp, Homo sapiens
ggatgcaggtggtgagaccctg

SEQ ID NO: 2559 - DNA, 24 bp, Homo sapiens
cgaaagggtgcttgaatttccaca

SEQ ID NO: 2560 - DNA, 24 bp, Homo sapiens
aggcagagctgtgattcattttca

SEQ ID NO: 2561 - DNA, 26 bp, Homo sapiens
aggacaatgccaagttttccaaagct

SEQ ID NO: 2562 - DNA, 23 bp, Homo sapiens
tggccatgcaatcatttccagcc

SEQ ID NO: 2563 - DNA, 23 bp, Homo sapiens
aagggtggaaatgacagtcatca

SEQ ID NO: 2564 - DNA, 23 bp, Homo sapiens
acctggtaaatgatgtacagagt

SEQ ID NO: 2565 - DNA, 24 bp, Homo sapiens
actgtgagtgatagaggtctctca

SEQ ID NO: 2566 - DNA, 24 bp, Homo sapiens
tcccaaatcacttgccaatgttgt

SEQ ID NO: 2567 - DNA, 24 bp, Homo sapiens
agaaacttaagaatcaataatggt

SEQ ID NO: 2568 - DNA, 23 bp, Homo sapiens
catgggtgagtcagagctgggtg

SEQ ID NO: 2569 - DNA, 23 bp, Homo sapiens
ggaagagcctggaagcctcactc

SEQ ID NO: 2570 - DNA, 23 bp, Homo sapiens
cccccgacacatcaagacacctg

SEQ ID NO: 2571 - DNA, 23 bp, Homo sapiens
cctcagggctgacagtttgctcc

SEQ ID NO: 2572 - DNA, 23 bp, Homo sapiens
ctaccaagtggcctccgggaaag

SEQ ID NO: 2573 - DNA, 23 bp, Homo sapiens
ccaggaggggagtgggtgataca

SEQ ID NO: 2574 - DNA, 23 bp, Homo sapiens
aacgctgtgcaagttctggacct

SEQ ID NO: 2575 - DNA, 22 bp, Homo sapiens
ccctcctctggggatctctggg

SEQ ID NO: 2576 - DNA, 23 bp, Homo sapiens
tgactcctcccaggtcaaccaca

SEQ ID NO: 2577 - DNA, 23 bp, Homo sapiens
ggcacaggatggggaagtcacag

SEQ ID NO: 2578 - DNA, 23 bp, Homo sapiens
tgcccagccaggtctatctgact

SEQ ID NO: 2579 - DNA, 22 bp, Homo sapiens
gggcctggtactctgtgggaac

SEQ ID NO: 2580 - DNA, 23 bp, Homo sapiens
atctccccatgtgtgaccccctt

SEQ ID NO: 2581 - DNA, 23 bp, Homo sapiens
ttagccctcccctgtgcctctag

SEQ ID NO: 2582 - DNA, 25 bp, Homo sapiens
acctgattatccacttggttttaga

SEQ ID NO: 2583 - DNA, 23 bp, Homo sapiens
agttgacgtcatcttgccccagc

SEQ ID NO: 2584 - DNA, 23 bp, Homo sapiens
tttcaaagcctcgtcctcccacc

SEQ ID NO: 2585 - DNA, 24 bp, Homo sapiens
ccacagctgtctccaagatctgct

SEQ ID NO: 2586 - DNA, 25 bp, Homo sapiens
cctgggaaacacaatggattaggcc

SEQ ID NO: 2587 - DNA, 24 bp, Homo sapiens
gccatgacttgggagagaacatgc

SEQ ID NO: 2588 - DNA, 25 bp, Homo sapiens
ccccaactaaaaactggtttccgca

SEQ ID NO: 2589 - DNA, 23 bp, Homo sapiens
ggaagcaccctaggcatggtctg

SEQ ID NO: 2590 - DNA, 23 bp, Homo sapiens
ggcagagaagacgtgctctccac

SEQ ID NO: 2591 - DNA, 23 bp, Homo sapiens
cagggattaggaggccacagcac

SEQ ID NO: 2592 - DNA, 24 bp, Homo sapiens
gcctgccctgatacatgaaacagc

SEQ ID NO: 2593 - DNA, 23 bp, Homo sapiens
tactgtcacaccgcccacaacag

SEQ ID NO: 2594 - DNA, 24 bp, Homo sapiens
acatccacaccactctgaagacgg

SEQ ID NO: 2595 - DNA, 23 bp, Homo sapiens
ccaggtcaacccactaaaggccc

SEQ ID NO: 2596 - DNA, 23 bp, Homo sapiens
ctgccatgccctactcttcccac

SEQ ID NO: 2597 - DNA, 23 bp, Homo sapiens
ttccccatctccaggactcggtt

SEQ ID NO: 2598 - DNA, 27 bp, Homo sapiens
gctctgaaagtattctggctctcaccc

SEQ ID NO: 2599 - DNA, 24 bp, Homo sapiens
tgcaagctttccaacacatctgga

SEQ ID NO: 2600 - DNA, 23 bp, Homo sapiens
tccaaagccttttacactcctca

SEQ ID NO: 2601 - DNA, 24 bp, Homo sapiens
gcacactgtcagttaccacaccca

SEQ ID NO: 2602 - DNA, 23 bp, Homo sapiens
ccaaatccactgctcctcaccga

SEQ ID NO: 2603 - DNA, 24 bp, Homo sapiens
gccagttggaaaatgaatgggcca

SEQ ID NO: 2604 - DNA, 23 bp, Homo sapiens
ggaggaggtgaagcagaccctca

SEQ ID NO: 2605 - DNA, 20 bp, Homo sapiens
tgcctcaaagataatgtaca

SEQ ID NO: 2606 - DNA, 20 bp, Homo sapiens
gacaggaacccgcagcctcc

SEQ ID NO: 2607 - DNA, 23 bp, Homo sapiens
gcgtgtgtgtggcttgcatgtag

SEQ ID NO: 2608 - DNA, 24 bp, Homo sapiens
acctctgtcttcagtctgtcccca

SEQ ID NO: 2609 - DNA, 23 bp, Homo sapiens
ggggcctagctacaaagtcaggc

SEQ ID NO: 2610 - DNA, 25 bp, Homo sapiens
acaaagcagcattaacacaccacca

SEQ ID NO: 2611 - DNA, 24 bp, Homo sapiens
tccaacagagaagcctacacaaca

SEQ ID NO: 2612 - DNA, 23 bp, Homo sapiens
cccttaccccagccttgtctgtt

SEQ ID NO: 2613 - DNA, 23 bp, Homo sapiens
tggtccagaagtggtggaaggga

SEQ ID NO: 2614 - DNA, 23 bp, Homo sapiens
gaagcaatcccctcccaggtcac

SEQ ID NO: 2615 - DNA, 24 bp, Homo sapiens
aggagcctgagactcctaagtggg

SEQ ID NO: 2616 - DNA, 23 bp, Homo sapiens
tgatgtgggtgagacaacactgt

SEQ ID NO: 2617 - DNA, 23 bp, Homo sapiens
cctccccaggccaatgtaccaag

SEQ ID NO: 2618 - DNA, 25 bp, Homo sapiens
tgcccaatatttgtccccaaccaca

SEQ ID NO: 2619 - DNA, 27 bp, Homo sapiens
tcccatgcttaaggaaatgtctgagct

SEQ ID NO: 2620 - DNA, 23 bp, Homo sapiens
tcactgatggccctctcctaccc

SEQ ID NO: 2621 - DNA, 23 bp, Homo sapiens
aagagctcaaggcaacagggcaa

SEQ ID NO: 2622 - DNA, 23 bp, Homo sapiens
ccaggagattagtgcagggcgag

SEQ ID NO: 2623 - DNA, 25 bp, Homo sapiens
agcacaaaacggtaaaatccactgt

SEQ ID NO: 2624 - DNA, 23 bp, Homo sapiens
gaggttctgcagaggtgtggctc

SEQ ID NO: 2625 - DNA, 23 bp, Homo sapiens
tctggctgaccctcttggatcct

SEQ ID NO: 2626 - DNA, 23 bp, Homo sapiens
tagcatctatagcataaagaaaa

SEQ ID NO: 2627 - DNA, 23 bp, Homo sapiens
cagcacatgtaaccaagccgcac

SEQ ID NO: 2628 - DNA, 23 bp, Homo sapiens
aacaccccaacgtcacagcatca

SEQ ID NO: 2629 - DNA, 24 bp, Homo sapiens
acgatgatagcacacacccttggg

SEQ ID NO: 2630 - DNA, 23 bp, Homo sapiens
ctacagaaaggtggcccgcctac

SEQ ID NO: 2631 - DNA, 23 bp, Homo sapiens
gcctggaaagcgcctagaaccaa

SEQ ID NO: 2632 - DNA, 23 bp, Homo sapiens
tgtctgtcatcattttactacat

SEQ ID NO: 2633 - DNA, 25 bp, Homo sapiens
tgaatgcaaaacaacactgtccact

SEQ ID NO: 2634 - DNA, 23 bp, Homo sapiens
ataccattgtccagagttcttga

SEQ ID NO: 2635 - DNA, 23 bp, Homo sapiens
tggtccacgtgtgaatggcttca

SEQ ID NO: 2636 - DNA, 25 bp, Homo sapiens
tcatctttacagagattaaccccca

SEQ ID NO: 2637 - DNA, 28 bp, Homo sapiens
ggaactatagaaaaacctataataacca

SEQ ID NO: 2638 - DNA, 26 bp, Homo sapiens
tggtcctatgcatttcttaatgttga

SEQ ID NO: 2639 - DNA, 23 bp, Homo sapiens
cctgcttgtgccacattgctcag

SEQ ID NO: 2640 - DNA, 24 bp, Homo sapiens
tctgaaaacaaagttgcaaagtgg

SEQ ID NO: 2641 - DNA, 23 bp, Homo sapiens
atgcttgcctgtgtgcatccatg

SEQ ID NO: 2642 - DNA, 24 bp, Homo sapiens
acaacttataagtttcacagaggt

SEQ ID NO: 2643 - DNA, 28 bp, Homo sapiens
ggtcaacttttagtctttggaaacctcc

SEQ ID NO: 2644 - DNA, 23 bp, Homo sapiens
agctcccagtagattcaagggga

SEQ ID NO: 2645 - DNA, 23 bp, Homo sapiens
gaaggaggctctggggactcgtg

SEQ ID NO: 2646 - DNA, 23 bp, Homo sapiens
cgtatcctgccatgcctgaggac

SEQ ID NO: 2647 - DNA, 22 bp, Homo sapiens
gagtagcacgctctgaggacgc

SEQ ID NO: 2648 - DNA, 23 bp, Homo sapiens
cacccggcttgctagtgagtctg

SEQ ID NO: 2649 - DNA, 23 bp, Homo sapiens
gtctcctcctctctcacctcccc

SEQ ID NO: 2650 - DNA, 23 bp, Homo sapiens
gacctctccttggtccgaagctg

SEQ ID NO: 2651 - DNA, 23 bp, Homo sapiens
cccctgggaggtagtgaaaggga

SEQ ID NO: 2652 - DNA, 23 bp, Homo sapiens
tcctgtgcttgtcccacttcagc

SEQ ID NO: 2653 - DNA, 23 bp, Homo sapiens
cccctaagcaaccacctgacagg

SEQ ID NO: 2654 - DNA, 23 bp, Homo sapiens
caggttccatccagcaagctcct

SEQ ID NO: 2655 - DNA, 24 bp, Homo sapiens
acagatgagtgtcccagtaaaggt

SEQ ID NO: 2656 - DNA, 23 bp, Homo sapiens
agacctcctatttctcggacgcc

SEQ ID NO: 2657 - DNA, 23 bp, Homo sapiens
cggtagggaggtggggtctgata

SEQ ID NO: 2658 - DNA, 23 bp, Homo sapiens
agcacgtattacagtgcatcagc

SEQ ID NO: 2659 - DNA, 23 bp, Homo sapiens
agcgtggcactacattctgcaga

SEQ ID NO: 2660 - DNA, 23 bp, Homo sapiens
ttgtatgcctgtatgctccatga

SEQ ID NO: 2661 - DNA, 24 bp, Homo sapiens
tctcattcacaggcttgcattgct

SEQ ID NO: 2662 - DNA, 23 bp, Homo sapiens
ccgatggaaagtggccacaggat

SEQ ID NO: 2663 - DNA, 26 bp, Homo sapiens
actgtttcacttaaagcaagtcagga

SEQ ID NO: 2664 - DNA, 25 bp, Homo sapiens
tggcctacagcagggtattcaaagg

SEQ ID NO: 2665 - DNA, 23 bp, Homo sapiens
ccatgcgctgcttccaatggatc

SEQ ID NO: 2666 - DNA, 23 bp, Homo sapiens
tgaaaggacagtctgctccccct

SEQ ID NO: 2667 - DNA, 23 bp, Homo sapiens
ttccccaaaggcatgaatgacca

SEQ ID NO: 2668 - DNA, 24 bp, Homo sapiens
tgccaagggttttcaagggctact

SEQ ID NO: 2669 - DNA, 23 bp, Homo sapiens
tgggagccaaccacactttctgg

SEQ ID NO: 2670 - DNA, 23 bp, Homo sapiens
tcagcatgcccaaccttccaaca

SEQ ID NO: 2671 - DNA, 23 bp, Homo sapiens
gggatggagaggcgagggagaaa

SEQ ID NO: 2672 - DNA, 24 bp, Homo sapiens
agccttatatgctcctttatgagt

SEQ ID NO: 2673 - DNA, 23 bp, Homo sapiens
tctctggaggcccaaattcccct

SEQ ID NO: 2674 - DNA, 23 bp, Homo sapiens
tgctcccatatgctgagatctga

SEQ ID NO: 2675 - DNA, 24 bp, Homo sapiens
agaacatggaagtttgctacgaca

SEQ ID NO: 2676 - DNA, 25 bp, Homo sapiens
acagtgtggagttacttatgttgca

SEQ ID NO: 2677 - DNA, 25 bp, Homo sapiens
ttgcatctgtgtgtgtgtttgtgca

SEQ ID NO: 2678 - DNA, 23 bp, Homo sapiens
ctggatgagggcaagggagaagc

SEQ ID NO: 2679 - DNA, 23 bp, Homo sapiens
aaacacagtaggggctggaggga

SEQ ID NO: 2680 - DNA, 26 bp, Homo sapiens
tggatcacaggatgaccaaatctcca

SEQ ID NO: 2681 - DNA, 23 bp, Homo sapiens
tgtacctggtttccgctcttgca

SEQ ID NO: 2682 - DNA, 23 bp, Homo sapiens
actcgaaaagactttcccccgcc

SEQ ID NO: 2683 - DNA, 23 bp, Homo sapiens
ggagagcccaagacacatcctcc

SEQ ID NO: 2684 - DNA, 23 bp, Homo sapiens
tcgcagtatttggatgggggcag

SEQ ID NO: 2685 - DNA, 23 bp, Homo sapiens
acagagcccccaggatgaagaga

SEQ ID NO: 2686 - DNA, 23 bp, Homo sapiens
tggaaggagattagcctggtcgg

SEQ ID NO: 2687 - DNA, 23 bp, Homo sapiens
gcagccgctttataaatgtttct

SEQ ID NO: 2688 - DNA, 23 bp, Homo sapiens
agtacagaggcatggagaggaat

SEQ ID NO: 2689 - DNA, 25 bp, Homo sapiens
tgtgatgcagaattccccctgatga

SEQ ID NO: 2690 - DNA, 23 bp, Homo sapiens
accaatgctctgttgcctcttaa

SEQ ID NO: 2691 - DNA, 23 bp, Homo sapiens
accctttggtgttgacatgcttt

SEQ ID NO: 2692 - DNA, 24 bp, Homo sapiens
acggtgacatcagaagacaagcga

SEQ ID NO: 2693 - DNA, 23 bp, Homo sapiens
aaaggcccagtttcagactcttt

SEQ ID NO: 2694 - DNA, 23 bp, Homo sapiens
aacccccaggctgttctctggaa

SEQ ID NO: 2695 - DNA, 24 bp, Homo sapiens
cagtcttgcatgttctaaaaatga

SEQ ID NO: 2696 - DNA, 23 bp, Homo sapiens
ctagaagcccagtgaagcccgga

SEQ ID NO: 2697 - DNA, 24 bp, Homo sapiens
actgaacacagtgtggagacgaga

SEQ ID NO: 2698 - DNA, 25 bp, Homo sapiens
tggatttcccatcggatttcagact

SEQ ID NO: 2699 - DNA, 26 bp, Homo sapiens
tcagaaagtgagtttaggatgtggct

SEQ ID NO: 2700 - DNA, 23 bp, Homo sapiens
tagccacacaggtgctgacaagg

SEQ ID NO: 2701 - DNA, 23 bp, Homo sapiens
agccaagttcaaacacatgagct

SEQ ID NO: 2702 - DNA, 23 bp, Homo sapiens
tgattgaactctgcccaggtgct

SEQ ID NO: 2703 - DNA, 23 bp, Homo sapiens
aggtcgacaacacacgcaatcga

SEQ ID NO: 2704 - DNA, 23 bp, Homo sapiens
cctggggatctctgagtctggct

SEQ ID NO: 2705 - DNA, 23 bp, Homo sapiens
ttccagccaaaccacccacgatt

SEQ ID NO: 2706 - DNA, 23 bp, Homo sapiens
gcagagcctgtcgcctatgtgta

SEQ ID NO: 2707 - DNA, 25 bp, Homo sapiens
tggatggcaactgtcttaatgccca

SEQ ID NO: 2708 - DNA, 23 bp, Homo sapiens
acttggtgaccagcaatcagcct

SEQ ID NO: 2709 - DNA, 23 bp, Homo sapiens
actgctccctggtgtgaaagctg

SEQ ID NO: 2710 - DNA, 23 bp, Homo sapiens
acaaagccatgctaccacactgc

SEQ ID NO: 2711 - DNA, 25 bp, Homo sapiens
tgacaaaatgtttaacttgaagaca

SEQ ID NO: 2712 - DNA, 25 bp, Homo sapiens
acctgttgactcaaccgtatctgct

SEQ ID NO: 2713 - DNA, 26 bp, Homo sapiens
tgcccagaaaatagaatcctgactgt

SEQ ID NO: 2714 - DNA, 22 bp, Homo sapiens
ccaccaggctctttggcaatgc

SEQ ID NO: 2715 - DNA, 23 bp, Homo sapiens
cactctgctgcaacttgcccaac

SEQ ID NO: 2716 - DNA, 23 bp, Homo sapiens
aaagactcctgagctctgctggc

SEQ ID NO: 2717 - DNA, 23 bp, Homo sapiens
ataccatggacccaggcttccct

SEQ ID NO: 2718 - DNA, 23 bp, Homo sapiens
acaaggacccctcaaactccagg

SEQ ID NO: 2719 - DNA, 23 bp, Homo sapiens
gagggccattccttacacagccc

SEQ ID NO: 2720 - DNA, 23 bp, Homo sapiens
aaagtgagcagggtcatggcctc

SEQ ID NO: 2721 - DNA, 23 bp, Homo sapiens
gcgtgggcctgaagaaagggtat

SEQ ID NO: 2722 - DNA, 23 bp, Homo sapiens
gtgatgactgcccagggacagtc

SEQ ID NO: 2723 - DNA, 23 bp, Homo sapiens
attgatttttcagatttccacct

SEQ ID NO: 2724 - DNA, 25 bp, Homo sapiens
tgctctcagtttaaagacagacact

SEQ ID NO: 2725 - DNA, 26 bp, Homo sapiens
tcctgcttggaattgtagaaatccca

SEQ ID NO: 2726 - DNA, 21 bp, Homo sapiens
acgcagtgataggtcgcggac

SEQ ID NO: 2727 - DNA, 23 bp, Homo sapiens
ttaagaccccatccctcccccag

SEQ ID NO: 2728 - DNA, 23 bp, Homo sapiens
ggccagctgagccacacctaaaa

SEQ ID NO: 2729 - DNA, 23 bp, Homo sapiens
acacgcactgaaaagcaaagcaa

SEQ ID NO: 2730 - DNA, 23 bp, Homo sapiens
tcaaacagtcaagcacttctgtt

SEQ ID NO: 2731 - DNA, 23 bp, Homo sapiens
agcaatggattgaatttgagtat

SEQ ID NO: 2732 - DNA, 23 bp, Homo sapiens
gagttggagaagctctggccagg

SEQ ID NO: 2733 - DNA, 23 bp, Homo sapiens
tcaaacggcaccaaaaacaggcc

SEQ ID NO: 2734 - DNA, 23 bp, Homo sapiens
aacaatcaagacccagggccacc

SEQ ID NO: 2735 - DNA, 23 bp, Homo sapiens
gcaggtccaccgtgtccatcata

SEQ ID NO: 2736 - DNA, 23 bp, Homo sapiens
atctgtcctacactgatgggagt

SEQ ID NO: 2737 - DNA, 23 bp, Homo sapiens
tttactcctcccccaccccatgt

SEQ ID NO: 2738 - DNA, 27 bp, Homo sapiens
tgtcctcgctagatgtgattaccctgt

SEQ ID NO: 2739 - DNA, 23 bp, Homo sapiens
accaacccaacttcacagttcca

SEQ ID NO: 2740 - DNA, 28 bp, Homo sapiens
tccacatagaatgatatgatggatcagt

SEQ ID NO: 2741 - DNA, 23 bp, Homo sapiens
ttaggccagaatagtagcatctt

SEQ ID NO: 2742 - DNA, 23 bp, Homo sapiens
aaacaaagcacatttccttggca

SEQ ID NO: 2743 - DNA, 23 bp, Homo sapiens
tcgtccactggaggcaaagcttc

SEQ ID NO: 2744 - DNA, 23 bp, Homo sapiens
aacccatagctgcctaagagtct

SEQ ID NO: 2745 - DNA, 23 bp, Homo sapiens
gacactccagcccccatcaggat

SEQ ID NO: 2746 - DNA, 23 bp, Homo sapiens
agccttggccatacctaatcaga

SEQ ID NO: 2747 - DNA, 23 bp, Homo sapiens
acacagaatccaccacactggct

SEQ ID NO: 2748 - DNA, 23 bp, Homo sapiens
gcagagactgtgcccacatttgc

SEQ ID NO: 2749 - DNA, 23 bp, Homo sapiens
ggaggtagatagggggccaccaa

SEQ ID NO: 2750 - DNA, 26 bp, Homo sapiens
ggaagaactttctggaggttgtccca

SEQ ID NO: 2751 - DNA, 23 bp, Homo sapiens
tcccacaccaaaacattttgtga

SEQ ID NO: 2752 - DNA, 25 bp, Homo sapiens
tggattgttgcatttcccaaacagt

SEQ ID NO: 2753 - DNA, 23 bp, Homo sapiens
ggcccccaccttcctctagactg

SEQ ID NO: 2754 - DNA, 23 bp, Homo sapiens
tgcctgaatagcacatggcctgg

SEQ ID NO: 2755 - DNA, 23 bp, Homo sapiens
tcatcccatgaaagtgcccagca

SEQ ID NO: 2756 - DNA, 23 bp, Homo sapiens
caggtcgcctgtggaaagctaca

SEQ ID NO: 2757 - DNA, 24 bp, Homo sapiens
gatacaggtggggaaactgaggcc

SEQ ID NO: 2758 - DNA, 23 bp, Homo sapiens
ggccaccagtctcgcatgtcttt

SEQ ID NO: 2759 - DNA, 23 bp, Homo sapiens
tatcaggaacacggaggacaggc

SEQ ID NO: 2760 - DNA, 23 bp, Homo sapiens
gagaggagctcgggttcaaggac

SEQ ID NO: 2761 - DNA, 22 bp, Homo sapiens
ccatccccacacgctctgagtg

SEQ ID NO: 2762 - DNA, 23 bp, Homo sapiens
cacagtgacccaggggaggcaag

SEQ ID NO: 2763 - DNA, 23 bp, Homo sapiens
atcaagtactcaactccaacctg

SEQ ID NO: 2764 - DNA, 23 bp, Homo sapiens
tgggttgttgctgccctctagtg

SEQ ID NO: 2765 - DNA, 23 bp, Homo sapiens
tgagtgttaacagggcccgtgtg

SEQ ID NO: 2766 - DNA, 25 bp, Homo sapiens
tggagagattccccacaagagtcca

SEQ ID NO: 2767 - DNA, 23 bp, Homo sapiens
gactcagtgaagaccccaaacca

SEQ ID NO: 2768 - DNA, 23 bp, Homo sapiens
acgcaacctccagctcacattca

SEQ ID NO: 2769 - DNA, 23 bp, Homo sapiens
acccagacccagtgcatcaacac

SEQ ID NO: 2770 - DNA, 23 bp, Homo sapiens
cagatctcactggttctagtgaa

SEQ ID NO: 2771 - DNA, 23 bp, Homo sapiens
gcacattgctacagcccaacctc

SEQ ID NO: 2772 - DNA, 26 bp, Homo sapiens
gcagtcttgctaattcatgtcaggca

SEQ ID NO: 2773 - DNA, 23 bp, Homo sapiens
gtgtgtggtgagttcccctgctt

SEQ ID NO: 2774 - DNA, 23 bp, Homo sapiens
aggtgccctagtagactctgccc

SEQ ID NO: 2775 - DNA, 26 bp, Homo sapiens
tgcagcttgggtagaacatcttctcc

SEQ ID NO: 2776 - DNA, 23 bp, Homo sapiens
ggcagcaagggtcagggaagtaa

SEQ ID NO: 2777 - DNA, 23 bp, Homo sapiens
acaacagagcattagcagcagcc

SEQ ID NO: 2778 - DNA, 23 bp, Homo sapiens
acaaaggtttctgggcagagggc

SEQ ID NO: 2779 - DNA, 22 bp, Homo sapiens
ctctcgcacccccaggctgatc

SEQ ID NO: 2780 - DNA, 24 bp, Homo sapiens
acaacgaaataaagagctgtttga

SEQ ID NO: 2781 - DNA, 23 bp, Homo sapiens
atggtcctaagagatgggaaggt

SEQ ID NO: 2782 - DNA, 23 bp, Homo sapiens
agtcatgccacatctccctcacc

SEQ ID NO: 2783 - DNA, 23 bp, Homo sapiens
atacccttttaactttttaagag

SEQ ID NO: 2784 - DNA, 26 bp, Homo sapiens
agccaaaacacactctttgtttgagt

SEQ ID NO: 2785 - DNA, 24 bp, Homo sapiens
acaccacaatacttgcaggctaga

SEQ ID NO: 2786 - DNA, 23 bp, Homo sapiens
tcctgattgctgccctcctccta

SEQ ID NO: 2787 - DNA, 23 bp, Homo sapiens
ggaacagggttggggtatcctgc

SEQ ID NO: 2788 - DNA, 23 bp, Homo sapiens
gcagagagctacggttgctgact

SEQ ID NO: 2789 - DNA, 21 bp, Homo sapiens
ctcctccccaaagcctgcgac

SEQ ID NO: 2790 - DNA, 24 bp, Homo sapiens
tccaaagcagatgacaacaggggg

SEQ ID NO: 2791 - DNA, 23 bp, Homo sapiens
ccatgtcacgctaccaggcagaa

SEQ ID NO: 2792 - DNA, 27 bp, Homo sapiens
gggtgaaaggacataaacatgcacacg

SEQ ID NO: 2793 - DNA, 23 bp, Homo sapiens
tgacatgcatggtgccaaggcta

SEQ ID NO: 2794 - DNA, 23 bp, Homo sapiens
ctggacctcagcagccacaagag

SEQ ID NO: 2795 - DNA, 23 bp, Homo sapiens
ttggtcaggcagatgctaggtgc

SEQ ID NO: 2796 - DNA, 23 bp, Homo sapiens
cccctcacctcagagatccccaa

SEQ ID NO: 2797 - DNA, 25 bp, Homo sapiens
tgccacaggtagtatctggtctgga

SEQ ID NO: 2798 - DNA, 25 bp, Homo sapiens
tgggaggaaaacacaaaaggagcca

SEQ ID NO: 2799 - DNA, 23 bp, Homo sapiens
ttgggagcctagaggggaagtgc

SEQ ID NO: 2800 - DNA, 23 bp, Homo sapiens
ggcctccttgagacagacaccac

SEQ ID NO: 2801 - DNA, 23 bp, Homo sapiens
tgtctctggcttcaaccaccact

SEQ ID NO: 2802 - DNA, 23 bp, Homo sapiens
aggcctaccactcctatggcaca

SEQ ID NO: 2803 - DNA, 23 bp, Homo sapiens
gtgcagggatgctgatttgctgt

SEQ ID NO: 2804 - DNA, 23 bp, Homo sapiens
aaaagcctcccttgtccccactg

SEQ ID NO: 2805 - DNA, 23 bp, Homo sapiens
ttcctaattccacgggcggcatt

SEQ ID NO: 2806 - DNA, 23 bp, Homo sapiens
tctttgtaccctgcgtgactgcc

SEQ ID NO: 2807 - DNA, 24 bp, Homo sapiens
ccatgactgggatgctaagtcagc

SEQ ID NO: 2808 - DNA, 23 bp, Homo sapiens
aggcctagtccagccttccctag

SEQ ID NO: 2809 - DNA, 23 bp, Homo sapiens
ttgtgcacggtcaggtggttcat

SEQ ID NO: 2810 - DNA, 23 bp, Homo sapiens
gcccaaggccctctccaaatcat

SEQ ID NO: 2811 - DNA, 22 bp, Homo sapiens
catgcagaagggaggcacaggg

SEQ ID NO: 2812 - DNA, 23 bp, Homo sapiens
ctctgctggcatgtgatggagct

SEQ ID NO: 2813 - DNA, 23 bp, Homo sapiens
cccagtccccatggttgagcttc

SEQ ID NO: 2814 - DNA, 23 bp, Homo sapiens
acccccgacatcctccagttcaa

SEQ ID NO: 2815 - DNA, 22 bp, Homo sapiens
ccatagtgctgagtgggagaca

SEQ ID NO: 2816 - DNA, 23 bp, Homo sapiens
ggagctgctctgcctgagtcttc

SEQ ID NO: 2817 - DNA, 23 bp, Homo sapiens
gccctgcctaagcttcttcctcc

SEQ ID NO: 2818 - DNA, 20 bp, Artificial Sequence
  Homotag primer
cagcgtccgctcttccgatc

SEQ ID NO: 2819 - DNA, 29 bp, artificial sequence
  Illumina P5
aatgatacggcgaccaccgagatctacac

SEQ ID NO: 2820 - DNA, 24 bp, artificial sequence
  Illumina P7
caagcagaagacggcatacgagat

SEQ ID NO: 2821 - DNA, 24 bp, artificial
  Seq Rd 1
cagcgtccgctcttccgatctctg

SEQ ID NO: 2822 - DNA, 24 bp, artificial
  seq rd 2
cagcgtccgctcttccgatcagac

SEQ ID NO: 2823 - DNA, 24 bp, artificial
  index read
gtctgatcggaagagcggacgctg

SEQ ID NO: 2824 - DNA, 26 bp, artificial
  sequencing read 1
ggcagcgtccgctcttccgatctctg

SEQ ID NO: 2825 - DNA, 31 bp, artificial
  sequencing read 2
ccgtttacagcgtccgctcttccgatcagac

SEQ ID NO: 2826 - DNA, 31 bp, artificial
  indexing read
gtctgatcggaagagcggacgctgtaaacgg

What is claimed is:

1. A composition for performing PCR comprising:
a universal primer having a sequence; and
a plurality of primer pairs, wherein each primer pair comprises a forward primer and a reverse primer, wherein the forward and the reverse primer comprises a general 5'-A-B-3' structure, where A is a sequence that is the same as the universal primer sequence and B represents a target specific sequence;
wherein the forward primers and reverse primers further comprise a spacer sequence, C, wherein the forward and reverse primers comprise a general 5'-A-C-B-3' structure, wherein the spacer sequence C of all forward primers is the same and the spacer sequence C of all reverse primers is the same, wherein each spacer sequence C is configured to provide directionality for generating a sequence library, wherein the spacer in each forward primer consists of the sequence TCTG and the spacer in each reverse primer consists of the sequence AGAC.

2. The composition of claim 1, wherein the sequence A possesses a melting temperature that is greater than the melting temperature of each target specific sequence B.

3. The composition of claim 1, wherein the plurality of primer pairs is at least 50 primer pairs.

4. The composition of claim 1, wherein the plurality of primer pairs is at least 500 primer pairs.

5. The composition of claim 1, wherein the universal primer and the plurality of primer pairs are at a ratio of between 2:1 and 10:1.

6. The composition of claim 1, wherein the universal primer sequence is SEQ ID: 2818.

7. The composition of claim 1, wherein the target specific sequence for each forward primer in the plurality of primer pairs is selected from the group consisting of SEQ ID NOs: 940-1878, and the target specific sequence for each reverse primer in the plurality of primer pairs is selected from the group consisting of SEQ ID NOs: 1879-2817.

* * * * *